United States Patent 10,724,096 (METHODS AND COMPOSITIONS FOR INHIBITING AND TREATING NEUROLOGICAL CONDITIONS) - sequence listing, part 106

SEQ ID NO: 1885 - DNA, 9503 bp, Homo sapiens
agattcaagacagtgttccgaaaagcacattggaaatcataactcatgtgaacatggaacactgggtgggtgcatgcgctgttttatccaggtttaccaggggagaatgacatggcctacatgtaactcaagatggtcgtggatgcagagacctcatggtgactgggtgcagaaaccttgtgacctgtgactgggtccttggattctgtgatctaagaccctgaggaaccatctgcatttatgccatgacggccaccgagtggtcaccttgttctgggcacagtgccctcaacttggcagctgaggctctgcttctgcaggagtgcaggtagatggggtccggctctgtcctctccctcccagggcagatgaggctctgctcctgtgggtgtgcaggtgggcggagtcctgctctgtcctctcccacccaggacagctgagggtctgctcctgcaggagtgcaggtggacggggtttggctctgacctcttcctcccagggcagctaaggggtctgctcctgtgggtgtgcagctgggcggagtccggctctgttctttccctcctagggcagtggatgccccaggcttgtctgttcccgctgagtctgtgtctcctgcctcagacttggtggtccacatgcagtactgctctgtgaatgatcctggaagggctgacccaacccaaagtacagcaggactaggagctgttggagctcaggccggtgaactgcaatttaagttatcccttgtctgtcttggtgttaaggagtggaatggaatcaagtttgtccttaagaaaataaagtgggcagctgaactctaaacctaactctgacttggtttcagtggctcagaggaaaaaccacaacaaacaaacaggaaaggaaagacttcccacccaagctaaattgttgtagggacaccagggtggatttgagcagcatcgcgaagatctcttcagctgagatgtacatcccgggaggcagcagccatgcacccagcatttctcaagctcagcacagcgggatgggggctgggagatgcttgtggggtcggtcttatggaatgggggatgttgagcacagccatgcacccagcgtttctcaagctcagcacgggggtgggggctgggagacgcttgtggggtacgtcttatgcactgggggatgttgagcagcatttctgggctccacctactacctgccggaagcacccccatttagtgacaaccaaacatatctccagatgtcaccaaatgtcccctgggggcagaattacctggttgggaactgctggtgtcatccaaagagcgtgagctttagaacaagacagacgcgtggaaccttctcacaagctgtgcagccggggggctcacaataggggctttccatggaaataaatggctataactgtgcctgcctgacctccctcagggtcccggaaagagcccctggtgagatggacgtgccgatggccacgggtgtcctctcaacaaggagatggtggctgaggggtgaggacacaggatggggcagagggcaggggtgagcagcggggacaggtctcggccgattctgagagaactcaggtgctgtgtgaactcaggggtctccgcaccgaggcaaggagtggccgtcctgccttcatgccgccagcctgggtggtgcgtgagtcagctcgggtgccatgacgggcatacacacccggggggcgtgtaaaggcacattcattccgcagggtcctggtggctggtgcccaagaccgtggagtcccaaggccagctcctgctgagcctctcctgggcacgcagacgccgtcctctccccatgtcctcatagggttgccccctctctgtctgtctgtgacctcatctccccttcttaggaggataccaggcagacaggatcagtgcccaccctggtgacctcattttaccttcttcacctctgtaaacgtcccatctccaaataatcacattctgaggtcccaagggttagggttcaacataggaatttggaggaacacaattcaggccataacttgtgtgtccttcccaaggaggggtgtggggaaggcagctttctcccgctgaatggctgagggcatgccctggagagactcagccattggctggcacctcctggcaggttggagcaggcaccttggtcctcgaggggtgagtgtggcatccacgcatcctgggggctcccatgtgggtggggttatgccaggcatgcagcgcctctgttggtggcctcctggtgtccatgagcccgtggctcccattccaagcatgagggcgataggagctggacggggccaaagggcccagtcacgtgtgcccagtcgcaggcggcttagatgggggttttgtacactcagctgtagtgtggcccacaggtttggagatggccataggaaagacagttcacaactcacagccccagaagagagtgaggccacaccgcaggcctgggggacacacctatgggtcaggaggcaggagaagagggaagcgtgggcaggagcctttgccacagtctctgggaaggagggagacacatacaaacatgcacacacatacacacataggcatgcatgcacacccatatacctgcacacatacacatatatgcacattacacatacacacacatacacacataggcatgcatgcacacccatatgcctgcacacacacatacacatatgtgcacattacacatacataaacacacatatgcacataggcatgcatgcacacccgtatacctgcacacatacacgtatacacacattacacatacccacacatacacacataggcatgcatgcacacccatataactgcacacatacacatatacgcacattacacatacacacataaacacacatacgcacatgggcatgcatgcacacccatatacctgcacacacacatacacatatacgtactttacacacacacacacacggcttaaaggaatgcagaagacatttccctgtgggaacgcacagcaatggacgataatgtttttcctcggttccagtgcctccaagagaatatgatgatataatcctggcccctttcacctgggctttgcagcttggaagaaagaaaagatattccagtttgtgcagtgttgaactatccctaaagcaagtaacaggagacgtcaaaatgtatgcttatgtcacccttatgaaaatgcctttttgttagaaattatgaacatcacccatcactaggtacaaggaggtaattagggtaattgattggcgttaaatgcagcagggactgcaaactggatttgcagagtctggtagccgtcgtggaaagaaatttattcattccttcactgaaggccataaagccattttggtttcagagcgtgcactaggccaccctgggctgagggctgcagggttcgaatgctgtaacataacggagagagatttgtttgctgaggcaggctggcattttagtattgctcttctgttcttttgatagtctccagacatatgctttggaatggggatttggtacttgaattcatgctttgaaattgactctggttgacattctttctgtattgaaatttcttctgtcaaagcctgcgaaattggcttcttaaatcagaaacagaaacatacaagctggtctcatttgttagttaatttgcaggctgctgaagaaaaaaatctttactttgttttttatggaaacatgtttttaattcacaaaaaaaatcccataaacctgccaaagtgaatctcttctttgatggcagaggagctgctcttccatctgccaccagccagcctcagcctcccttcccgaactgagcttttcacacattcccaggagagtggcagcgtgagctcccccgtgcccaggaactgggtggccgggcctccttctgccccatcgcctctgcctgcaccttctgctggtccagctcagacaaaagtaaacccggacctcaccccaggacctttcctgatcctggcccctcccgtcagccgacagtgaccttcaacacgtgtcccctccacactggcttctccaccctgatgatgctaccactcatttcatgtccatctcctgtaccgaattgtaatgtcattgagaactgtggcttttcttaaattaaaaataagggtgtttattacaaaagtcatatagggttcatgtagacaatttaaaaatataaagaaaagtcattgaaaaccctgtaatcttcatctcctagtgacggtccctgtttcacatcttctggctgcttctgcacataacacagttacatctttaaaagacataaaaatgtcaagtgctttaaaaattgcttttccccctcatgagcatcttttcatcactaaatgcacattctggaatagtattttgggtagctgggtagtatccatcctgtgcttttcgccctcgtgagcatcttttcatcgctaaatacacattctggaatagtatttttggtagctgggtagtatccatcctgtggttttaataaatattgtaagccatcccctatgatacagtactgttgtcatttctcctctttccctgattaccaattccccagtccctgaccctgggctgcattgtcttggggaagcttcatggaaggaaagttgcccactctaaggacatgaccagtccgaaggcctccagtcatctccagaaagaccgggcgctccactgcccgccacctggcctgaagacacggagataagaattgtcaagtccccaaagttgtgaattctttattcttccttagtcatctttttccagtgctcaaacttcctcactgtcaggaaatgtaaaccaaaattcacacggacaaaatgtgaacaaaacattggcaaatgtacacctgttttcttaactgctgatttcttgctgagagaacctgctgtggctgaggccccaggcctgtctcttacctgacctacagctctgcagctctgcggtgtcatctgtgggacatttacattgaccatgtcattaatacccgatatggtttgtgtccccaccgaaatctcgttttgcctggcagctcccataatcctcatgtgtcatgagagggacccagtaggaggtgactgaatcatggggtgggtctttcctgtgctgttttcatgatggtgactaagtcttatgagatctgatggttttttaaaagggagttcccctgcacacactctcttgcctgccaccatgtaagacatgactttgctcctcattcgccttctgccatgactgcgaggcctccccagccacgtggaactgagtcagttaaacctctttcctttataaattgcccagtctggggtatgtctttattagcagtgtgagaagagatgcatacaatacctccaattccctttcagcgcggtctgtattcctctttgaacacgtgcagacctgggcacaaggcaccaggtcataaaggctttagaagaacccggctggagagcaccacagacaccgcctgtccagctcacggtcacagttcaggatccttgtcctgagcctttgggcctcttggaatctgggtggagggagaatctggaacttcccatcctgtccaaccctctcctcatcacagcatctggatcttctagtgtgcgtggtgctagggtgtcactgtgagctgccgtgtgcctgggccaccttgggggtgctacagctgtgatccacctgcaccgtgacccacaggggcctgcgggactgtggtgttgggtgtccgcgcctcgttactgggggactgtgtggtgttggggtgtccgcgcctcgtttctgggggactgtgtggtgttggggtgtccgcgcctcgttactgggggactgtgtggtgttggggtgtctgcacctcgttactgggggactgtgtggtgttgggtgtccgcgcctcgttactgggggactgtgtggtgttgggtgtccgcgcctcgttactgggggactgtgtggagttggggtgtccgcgcctcgttgctgcgggactgtgtggtgttggggtgtccgcgcctcgttgctgcgggactgtgtggtgttggggtgtcggcgcctcgttactgggggactgtgtggtgttgggtgtccgcgcctcgttactgggggactgtgtggtgttggggtgtccgcgcctcgttactgggggactgtgtggtgttgggtgtccgcgcctcgttactgggggactgtgtggtgttggggtgtccgcgcctcgttactgggggactgtgtggtgttggggtgtctgcacctcgttactgggggactgtgtggtgttggggtgtctgcgcctcgttactgggggactgtgtggtgttgggtgtcggcgcctcgttactgggggactgtgtggtgttggggtgtccgcgcctcgttactgggggactgtgtggtgttggggtgtccgcgcctcgttgctgggggactgtgtggtgttcgggtgtccgcgcctcgttactgggggactgtgtggagttcgggtgtccgcgcctcgttgctgcgggactgtgtgttgttggggtgtcggcgcctcgttactgggggactgtgtggtgttggggtgtccgcgcctcgttactgggggactgtgtggtgttgggtgtccgtgcctcgttgctggtggactgtgtggtgttgggtgtccgcgcctcgttgctcggggactgtgtggtgttggggtgtccgcgcctcgttgctgggggactgtgtggtgttggggtgtccgcgcctcattactggggggctgtgtggtgttggggtgtccgcgcctcgttactgggggactgtgtggtgttggggtgtctgcgcctcgttactgggggactgtgtggtgttgggtgtccgcgcctcgttactggggggctgtgtggtgttggggtgtccgcgcctcgttactggggggctgtgtggtgttggggtgtccgcgcctcgttactgggggactgtgtggtgttggggtgtccgtgcctcgttactgcggggactgtgcagtgtccgggtgtccgcgcctcgttactgggggactgtgtggtgttggggtgtccgcgcctcgttgctggggggctgtgtggttttggggtgtccgcgcctcgttactgggggactgtgtggtgttgggtgtccgcgcctcgttgctgggggactgtgtggtgttggggtgtccgcgcctcattgctgggggactgtgtggtgttggggtgtccgcgcctcgttactggggggctgtgtggtgttggggtgtctgcgcctcgttactgggggactggtgttggagtgtctgcgcctcgttactgggggactgtgtggtgttgggtgtctgcgcctcgttgctgggggactgtgtggtgttggggtgtccgtgcctcgttactggggggctgtgtggttttggggtgtccgcgcctcattactggggggctgtgtggtgttggggtgtccgcgcctcgttactggggggctgtgtggtgttggggtgtccgcgcctcgttactgggggactgtgtggtgttggggtgtccgcgcctcgttactgggggactgtgtggtgttggggtgtccgtgcctcgttactgcggggaccgtgcagtgtccgggtgtccgcgcctcgttgctgcgggactgtgtggtgttgaggactccttgccacacggggtccatggtaaggggagctcctgctcgtccaggctggaagtccaggatatgtgagtgacagaaatgagcatgcctctccctctcccttggctcctgtcctgggctgcaatgtggaagatgtcagatctgccggagcactggtgtggcatggcatttaggaatgaatacaggggccttcagccagaagacctgccttcaccaccagccacgcagatccctgctggtagtgctgtcgatcggctcacaggcaatatggacactggaaagatggcaggttccttttctgatgatataagtagtatacctcagtagctaagtattttacagcaaggaaaaaaaataccctgtctgaagaccttttaaatatggaaattttttattttctttctctgtaaacagcatttggggagattctcttctcctacatgaaaaacatgctatgttagttccttgactacagactgtgggtgatgagctagttgctgtggaaagctttggagttctctacactcagcgactgcatgctgtgttcttttgcctttgtaaacgtgagtttgacctatggagtgaactttacccagagcctctggggagctgttcaaagctaatgaaccgtggggaaaagaaaccaggtcctgacctgcagggagcagctcccgcaatggaaaccattgtgttccagttccatgactttttgctcatggctatgttgggtttccagtttcacagatggtggatggaaacagaatactggcctgcactgtcatcttcatggtttaccctcccctcagagagacacgtaacgcaaacacacagcaggcagcctgtggggccgttatgggtgatatataaaatgcacgtgggttcagttctcgaacagtcagatacacagcacaggggggttatatgtatgggctctcagctctgtgcaaggcagatatatagcaagtacatgggcccagttctgtgcctggcagatatataacaggcataggtgctcacctctgtgccaggcagatgtataacatgcacagttgctcagtttggtaccatgcggatatataatacgcacgggtgctgagttctataccacacagatatataacattcatggttgctcaagtctgcaccaggcagacacataacatgcatagttgctcagctctgtaccaggcagacatataacaagcacaggtggtcagctctgtaccacacagatatattgcatgcacaggcaggtgctgagttccataccacacagatatgtaacattcatggttgctcaggtctgcaccaggcagacatataacatgcgtgggtgctgagttccataccacacagatatatagtattcatggttgctcaggtctgcaccaggcagacatataacatgcatgggtgctcagctctgtacgaggcagacgtataacacgcacaggtgatcagctctgtaccacccagatatataacatgagcgggtgctgagttctgtaacaggcagacatattccatgcacaggtgcttggtgatatgtcaggtggaatgtgatgtggctgggcaagatccttttgcaactctgagtactgagaatttgcatgtatgatagaacttggcttctagatttaaaaccgtcctcttttatttgcttgcaattaagatataagtatacaataagataggcattttctcccttgttttcttttttttttttccttttcttctctgttcagtttctcaactttcaatttcctcttataccagagggaaataaaactaaattttagccagtgctttgtcccagctgctgagattgca

SEQ ID NO: 1886 - DNA, 2641 bp, Homo sapiens
atacctccaattccctttcagcgcggtctgtattcctctttgaacacgtgcagacctgggcacaaggcaccaggtcataaaggctttagaagaacccggctggagagcaccacagacaccgcctgtccagctcacggtcacagttcaggatccttgtcctgagcctttgggcctcttggaatctgggtggagggagaatctggaacttcccatcctgtccaaccctctcctcatcacagcatctggatcttctagtgtgcgtggtgctagggtgtcactgtgagctgccgtgtgcctgggccaccttgggggtgctacagctgtgatccacctgcaccgtgacccacaggggcctgcgggactgtggtgttgggtgtccgcgcctcgttactgggggactgtgtggtgttggggtgtccgcgcctcgtttctgggggactgtgtggtgttggggtgtccgcgcctcgttactgggggactgtgtggtgttggggtgtctgcacctcgttactgggggactgtgtggtgttgggtgtccgcgcctcgttactgggggactgtgtggtgttgggtgtccgcgcctcgttactgggggactgtgtggagttggggtgtccgcgcctcgttgctgcgggactgtgtggtgttggggtgtccgcgcctcgttgctgcgggactgtgtggtgttggggtgtcggcgcctcgttactgggggactgtgtggtgttgggtgtccgcgcctcgttactgggggactgtgtggtgttggggtgtccgcgcctcgttactgggggactgtgtggtgttgggtgtccgcgcctcgttactgggggactgtgtggtgttggggtgtccgcgcctcgttactgggggactgtgtggtgttggggtgtctgcacctcgttactgggggactgtgtggtgttggggtgtctgcgcctcgttactgggggactgtgtggtgttgggtgtcggcgcctcgttactgggggactgtgtggtgttggggtgtccgcgcctcgttactgggggactgtgtggtgttggggtgtccgcgcctcgttgctgggggactgtgtggtgttcgggtgtccgcgcctcgttactgggggactgtgtggagttcgggtgtccgcgcctcgttgctgcgggactgtgtgttgttggggtgtcggcgcctcgttactgggggactgtgtggtgttggggtgtccgcgcctcgttactgggggactgtgtggtgttgggtgtccgtgcctcgttgctggtggactgtgtggtgttgggtgtccgcgcctcgttgctcggggactgtgtggtgttggggtgtccgcgcctcgttgctgggggactgtgtggtgttggggtgtccgcgcctcattactggggggctgtgtggtgttggggtgtccgcgcctcgttactgggggactgtgtggtgttggggtgtctgcgcctcgttactgggggactgtgtggtgttgggtgtccgcgcctcgttactggggggctgtgtggtgttggggtgtccgcgcctcgttactggggggctgtgtggtgttggggtgtccgcgcctcgttactgggggactgtgtggtgttggggtgtccgtgcctcgttactgcggggactgtgcagtgtccgggtgtccgcgcctcgttactgggggactgtgtggtgttggggtgtccgcgcctcgttgctggggggctgtgtggttttggggtgtccgcgcctcgttactgggggactgtgtggtgttgggtgtccgcgcctcgttgctgggggactgtgtggtgttggggtgtccgcgcctcattgctgggggactgtgtggtgttggggtgtccgcgcctcgttactggggggctgtgtggtgttggggtgtctgcgcctcgttactgggggactggtgttggagtgtctgcgcctcgttactgggggactgtgtggtgttgggtgtctgcgcctcgttgctgggggactgtgtggtgttggggtgtccgtgcctcgttactggggggctgtgtggttttggggtgtccgcgcctcattactggggggctgtgtggtgttggggtgtccgcgcctcgttactggggggctgtgtggtgttggggtgtccgcgcctcgttactgggggactgtgtggtgttggggtgtccgcgcctcgttactgggggactgtgtggtgttggggtgtccgtgcctcgttactgcggggaccgtgcagtgtccgggtgtccgcgcctcgttgctgcgggactgtgtggtgttgaggactccttgccacacggggtccatggtaaggggagctcctgctcgtccaggctggaagtccaggatatgtgagtgacagaaatgagcatgcctctccctctcccttggctcctgtcctgggctgcaatgtggaagatgtcagatctgccggagcactggtgtggcatggcatttaggaatgaatacaggggccttcagccagaagacctgccttcaccaccagccacgcagatccctgctggtagtgctgtcgatcggctcacaggcaatatggacactggaaagatggcaggttccttttctgatgatataagtagtatacctcagtagctaagtattttacagcaaggaaaaaaaata

SEQ ID NO: 1887 - DNA, 2544 bp, Homo sapiens
catacttttccagggcatatacttttatttgtctgctggtttacttaattgctggtagccccagctgctagcagtagtagtctaattcctgatagggcagtccagtgcacagaagggctccttgccgctctgctcggctcagtttttctgtagctcttaaactttctccccaccccacttaatagagtacatgttattgatttggaaactggtatcaaagctggtgggagaacgagatataccagtgaatataaaagtcaagaatgacacgtttcagctgcaagaatatagcttttttattaaaaagtttttgcaccgtgtattatctggcctttgtgggcagatggaagtgatgcccatcaatatagaatgtgtaatgatgtacacgtgcaaatatgctcctggctcttagaaacgttttgatgaagcgctcgagttcattcccatgcaggccaatgcatggattctgaaaataactgaaaattagtgtctcgttcctttcatcctcaccgattttctaaagaggccaccgcaaaggagagagcatgttccaccatgatggtcctgtttcacccagtgcgtgggggtgctccagatgtgagcagtatgaacgaagacaactttcctttgatgtgggacacaacttttaccaaccttccccaaacatatcttcctgtttcctgtgggattgtagtgtacacttgtttaatgattgctaaagtaatggagaaacaaatgtgaatctggcctgcatgcttcctttccttcctcagaaacaaagtggggctctggaatccttgctgtgcctgtggaatgtgtcaggaaacacaaccctgagttcattagttgagattggcagcaaagcagccttgggtctggtggagctgtggtagtaggggtccttctagtccttaccatggagagtggtcactctgttgctttcaaggtttcccaaagccggcatttgtattcataatgtcattttgtgcatttgggttattttcgccaagttcatagcagctgtaaataagaagatatttaagtctgtttttttttttttttttaagattagaggtatttctctgttttgtaacgcacatgttctcagtagggatttgtctgttgacagaatgagggctctctaaagaaacacatatattcaaggctcttcttaacatctacttcaggtctatctgccaggctagtgatgtgttttttgggatccttatccaccatgaaatctagtgttgcttgttctatatttgatgccatcttttaaagtaacaggctatgagtagtttgttgccgtccacatgtgcttttccagccattcaaaaccttttttttctaagacccaacatgcaccccttgattatttttgggttaccttattattcattgcacttatgcaggggcagtgggtccattcctgcggcattcctatgatatccaattatagtaactgtgtttgtgttgctcagttagaagttgaatgagctggagatttaatgatctagttaatcagtttataattggtaatcagaaagactgagggtttaatcagccagtgtgatatcatatgagccattggttcccagatgctggtccaacaaccacaagtattcacagatttctaggcccatctggggagattcttattcagtatgtctcaatatagactctaggaatctatcatttttcgaggttccatggaagtttctggtgcagggatgtcaaagtatgcatggtataatgactatgtcttttagtgataatgtttttcatctctgtgtgtctcagatactgctggaatgccttaactaccttctttaatggaatatgtttatatgggcattctgggctatgtgggagaaggaacctcaggctggccatcggggacctggttctagccttggttctgccactctctcaacctttcatcaggttagagaagtctaatctctgtgtaggtctaattcataaattgagagcatcagattatgcaaaaggcatttttcagctttctaacattcttcgaagagctttgcctccctaggaattgcttttgttgtcactgttcacgaacagctgttgcctcatttagtttagcgtgtgcctagcccctcaaccaaacatgaatcacggtctgcttctcaggagagctggtagctctccccgaattcaggatggcctcttttcctcttctgttactgccactaccaatcacccacaacaagaccaaagtacactgttttttttttgagacagagtctcactttgtcgcccaggctggaatgcagtggtatgatctcggctcactgcaacctctgccttctgggttcaagcaattctccttccacagcctcccaagtagctgggattacaggtgcatgccaccactcctggctaatttttgtatttttagtacagacggggttttaccatgttggccaggctggtctcaaactcctgacctcatgttatctgcccacctcgtcctcccaaagtgctgggattacaggcgagaaccaccgtgcccagcct

SEQ ID NO: 1888 - DNA, 26 bp, Homo sapiens
caccactcattgggagcaacacagaa

SEQ ID NO: 1889 - DNA, 6422 bp, Homo sapiens
aaaaggatattttcataaacaaatattatagtaagggctagcctaatgtatataaaggataatatatatttttaaagttagaaattgcctctaatttttaatatgtactataaaatccacacaatttagaaattttctttgaaatcaatttaaaagaaattgttttttaaaaagtatgtaagtgtttaaatatataaaatttaaatatatactaaaatataactctgaaatttaaatatttactaggatatatacataaaacagcttgctgcattgacctggggctcacacacctcagactcttgtagaagaaaaaaatcaaacaaaacaatacagtcagtgttgcaagctgcaatatagaacagtcccaatcttgccttaggttatttgttctttttttttattattatactttaagttttagggtacatgtgcacatcgtgcaggttagttacatatgtatacatgtgccatgctggtgcgctgcacccactaaatcgtcatctagcattagttatatctcccagtgctatccctccccctgccccccaccccaccacagtccccagagtgtgatattccccttcctgtgtccatgtgatctcattgttcagttcccagctatgagtgagaatatgcagtgtttggttttttgttcttgcgatagtttactaagaatgatgatttccaatttcatccatgtccctacaaaggacatgaactcctcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagctgcatgatttacagtcctttgggtatatacccagtaatgggatggctgggtcaaatggtatttctagttctagatccctgaggaatcatcacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgacgaacattttttcatgtgtgttttggctgcataaatgtcttcttttgagaagtgtctgttcatgtccttcgcccactttttgagggggttgtttttttttttcttgtaaatttgttttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctgtgtcctgaatggtaatgcctaggttttcttctagggtttttatggttttaggtctaacgtttaagtctttaatccgtcttgaattgatttttgtataaggtgtaaggaagggatccagtttcagctttctacatatggctagccagttttcccagcaccatttattaaatagggaatcctttccccattgcttgtttttctcaggtttgtcaaggatagatagttgtagatatgtggcgttatttctgagggctctgttctgttccattgatctatatctctgttttggtaccagtaccatgctgttttggttactgtagccttgtggtatagtttgaagtcaggtagtgtgatgcctccagctttttcttttggcttaggattgccttggcgatgcgggctcttttttggttccatactaactttaaagtagttttttccaattctgtgaagaaagtcattggtagcttgatggggatggcattgaatctgtaagttaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctattattggtgtataagagtgcttgtgatttttgtacattgattttgtatcctgagagtttgctgaagttgcttatcagcttaaggagattttgggctgagacagtggggttttctagatatacagtcatgtcgtctgcaaacagggacaatttgacttcctcttttcctaactgaataccctttatttccttctcctgcctaattgccctggccagaacttccaacactatgttgaataggagtggtgagagagggcatccctgtcttacgccagttttcaaagggaatgcttccagtttttgcccattcagtatgatattggctgtgggtttgtcatagatagctcttattattttgaaatacgtcccgtcaatacctaatttattgagagtttttagcatgaagggttgttgaattttgtcaaaggctttttctgcatctattgagataatcatgtggtttttgtcttgggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttgtattgattggaatagtttcagaaggaatggtaccacttcctccttgtacctctggtagaattcgtctgtgaatccatctggtcctggactctttttggttggtaaactattgattattgccacaatttcagctcctgttattggtctattcagagattcaacttcttcctagtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctcttttttttctttattagtcttgctagcggtctatcaattttgttgatcctttcaaaaaaccagctcctggattcattaattttttgaagggttttttgtgtctctgtttccttcagttctgctctgattttagttatttctagccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttcttccttcatttcgttatgtacccagtagtcattcaggagcaggttgttcagtttccatgtagttgagcggttgtgagtgagattcctaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtttaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgttgaattgatccctttaccattatgtaatggcattctttgtctcttttgatctttgttggtttaaagtctgttttatcagagactagtattgcaacccctgcctttttttgttgtccatttgcttagtagatcttcctccatccttttattttgagcctatatgtgtctctgcacgtgagatgcgtttcctgaatacagcacactgatgggtcctgactctatccaatttgccagtctgtgccttttaattggagcatttagtccatttacatttaaagttaatgttgttatgtgtgaatttgatcctgtcattatgatgttaggggtgattttgctcgttagttgatgcagtttcttcctagtcttgatggtctttacattttggcttgattttgcagtggctggtactggttgttcctttccatgtttagcgcttccttcaggagctcttttagggcaggcctggtggtgataaaatctctcagcatttgcttttctgtaaagtattttatttctccttcacttatgaagcgtagtttggctggatatgaaattctgggttgaaaattcttttctttaagaatgttgaatattggcccccactctctcctggcttgtagggtttctgccaggagatctgctgttagtctgatgggcttccctttgagggtaacccgacctttctctctggctgcccttaacattttttccttcatttcaactttggtgaatctgataattatgtgtcttgaagttgctcttctcgaggagtatctttgtggcattctctgtatttcctgaatctgaacgttggcctgccttgctagattggggaagttctcctggataatatcctgcagagtgttttccaccttggttccattctccccatcactttcaggtacaccaatcagacgtagatttggtcttttcacatagtctcatatttcttggaggctttgctcgtttctttttattcttttttctctaaactttccttctcacttcatttcattcatttcatcttccattgctgataccctttcttccagttgatcgcatcggctcctgaggcttctgcattcttcacgtagttctcgagccttggttttcagctccatcagctcctttaagcagttccctgtattgcttattctagttatacattcttctaaatttttttcaaagttttcaacttctttgcctttggtttgaatgtcctcccgtagctcagagtaatttgatcgtctgaagccttcttctctcagctcgtgaaagtcattctccatccagctttgttccgttgctggtgaggaactgcgttcctttggaggaggagaggcgctctgctttttagagtttcccgtttttctgttctgttttttccccatctttgtgtttttatctacttttggtctttgataatagtgatgtacagatgggtttttggtgtggatgtcctttctgtttgttagttttccttctaacagacaggaccctcagctgcaggtctgttggaatagcctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttccaggctgctttgtttacctcagcaagcctgggcaatggcgggcgcccctcccccagcctcgctgccgccttgcaggttgatctcagactgctgtgctagcaatcagcgagactccatgggtgtaggaccctccgagccaggtgcgggatataatcttgtggtgcgtcgtgttttaagccggtcggaaaagcgcagtattcgggtgggagtggcccgattttccaggtgcgtccgtcacccctttctttgacttggaaagggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacctggcttctgcgtcactcaggctgggagctgtagaccggagctgttcctattcggccatattggctcctcccccc

SEQ ID NO: 1890 - DNA, 5774 bp, Homo sapiens
ggaggaagacattccaagtctgaatctctggttaccactctgatggaaatacgcagctacaacccaatagaaggtcacatgctccagacagggaactcatctaatgatatgggggtgcaggggtgggggatcactaggagagtgcaggagtaaagaggtttctacacttatcctaacgaatgaaccacaaaagcatcatgctgaagcaaaagaagccagccacaaaacaaaggcatgctatacaagcccatttataacagaacagaatggaaattttataaaagttcaagaacaagcaaaactaatctatgatgattgaattcagaataatggttatcttggggttggtgagaagggagcaaataagaacttcatagggaactagaaatgttctatatctttgcaatgtatctatgtaataaaactgcacttgcacctcttaaatttaaacaaaatttttgagatttttcgtgaaaacggccatactgcccaaggtaatttatagattcaatgccatccccatcaagctaccaatgactttcttcacagaattggaaaaaactactttaaagttcatatggaaccaaaaaagagcccacaatgccaagttaatcctcagccaaaagaacaaagctggaggcatcacgctacctgacttcaaactatgctacaaggctacagtaaccaaaacagcatggtactggtaccaaaacagaacagaacagagccctcagaaataataccacatatctacaactatctggtctttgacaaacctgacaaaaagaagcaatggggaaaggattccctatttaataaatggtgctgggaaaactgcctagccatatgtagaaagctgaaactggatcccttccttacaccttatacaaaaattaatccaagatggattaaagacttatatgttagacctaaaacgataaaaaccctagaagaaaacctaggcaataccattcaggacataggcatggtcaaggacttcatatctaaaacaccaaaagcaatggcaacaaaagccaaaattcacaaatgggatctaattaaactaaagagcttctgcacagcaaaagaaaccaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgggactgtaaactagttcaaccattgtggaagtcggtgtggaaatcggtagattgctcagggatctagaactagaaataccatttgacccagccatcccattactgagtatatacccaaaggattataaatcatgctgccataaagacacatacacacgtatgtttactgcggcactattcacaatagcaaagacttgaaaccaacccaaatgtccaacaatgatagactggtttaagaaaatgtggcacatatacaccatggaatactatgcagccataaaataggatgagttcatgtcctttgtaggggcatggatgaagctggaaaccatcactctcagcaaactatcgcaaggacaaaaaaccaaacaccacatgttctcactcataggtgggaactgaacaatgagaacacacggacacaggaaagggaacatcacacatcggggactgttgtggggtggggggcggggagggatagcattaggagatatacctaatgctaaatgacgagttaatgggtgcagcacaccaacatggcacatgtatacatatgtaacaaacctgcacattgtgcacatgtaccctaaaacttaaagtataataaaaaaaaattttactctaagttccaggatacatgtgtagcatgtgcaggtttgttacataggtatacacgtgccatggtggttggctgcccctatcaatctgtcatctatattttaagccccgcatgcattaggtatttgtcctaatgctctccctcctcttgccccccacccctgacaggccccagtgtgtgatgttcctctccctatgttcatgtattctcattgttcaacttccacttatgagtgaaaacatgtggtgttaaacaattttttaaaaaatgttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagta

SEQ ID NO: 1891 - DNA, 3321 bp, Homo sapiens
ccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagta

SEQ ID NO: 1892 - DNA, 1342 bp, Homo sapiens
taatgaagcaagatcttccctctgtaagaacattacatttcttccactccatgacctggctcaagttcactatgaaaatgatcactgccagtaggaaaattcctccagaaggatttttatcacatttccctttgaagaggagcaaggaatcaacaattggcatcccttggaagatgaaagcaagttcctctgtattcggaacggatgttcctctggaatcagagtaatctcttaatggaccctgatgacataacgtggcacgggcttctcgtctgaaatggcaggttactcagcaagacagagggagagaagcagatggatgtgacagtaaattctgctatgtacccacagacacttctaagacattaaaaagtagtgcccacatttccgactcccacaacgaaacctgtgaagaaatcctgacgttgatttcaggagcatgtgggatcttgcctctcttacaatgcgggtccctcactctggttatgccaagcacagcttaaactgacccctctggttgtgagaaagtaagccaagaggagactaagattctaacaggtttattttatctactcaaaaggaacactagatctggagtctggtgaagaagattcaagctctcattctgtgacttactagcaatgacacagagggttgcctcagttgccttatctgtgaaatctaaggaacaaggaagacagtgccacatggttattctgaagacgagatcagctcctatcccttgggccactctccatctttctcattttgctctacaatagaccttgacagtttcctgtcaccagctttttccctcctcagtgtcttcgcactgtctgttccctatacctggaatgctttttcctccgctgttcccatcatcaggacctcctttttatccttcagatttcagcttaaacgtctcatgctctgagaggccttttcttgctagagcagggtctttgtccatcagtcttcaccacagctctgcttattacctcccccataacactgtccaaaatctgtaattagttttttcacctgtgtattgatgtctccctatactagaatctggacatgaaaagactgtatcctcattctctagtacaatgccaggcatttaagcatttaatattcacagaatgaatgactgtactagaaaacgcttggaggctatacagtcctatatacatataagggactatgggactatatatatatatatatatatatatatgtatatgtatgtatttatctaggacttatattctgtgtgtgtgtgtgtgtgtgtgtgtgtgtgtatgagataaaagtatatatacccaagatatttatattatat

SEQ ID NO: 1893 - DNA, 1507 bp, Homo sapiens
ggcttaattgattgaaccagattcgagaaaacagtgctaaattataattttctcaatactgtaaatatttttcaatcttcagcttcattaacttctataatttgaaattatcccaattattacctgacatgtactaaaattccctaaaatggatcttgagtaacattttcacagtacgataatttttctctctgtatatatttatatagtcacatatatgcacatacattatacaagcattacttttctataactgtaaggtcagaatttgaagttgtgttttctttatctttttatttccaatacttggcatcaagttgatattcattagaagtaaaggaggaaggaaatgaataatcttcagatactaagaacattacacttaaattattattaaatctaatttgcattctcatatattggcttagcttggttatttgtaacaagaatataaaaatatatgtgactgggaatgacatgaatagaaacttctggaaaatggaatggtaaggtctagagaagtggtaaatatttcatcactggaaatgagcaagcagaggttaggttattctttgacattgatattgaagcagagagtctctataatggatagaaagttcaaagtgacctttaggatcttttatcttcaaatttctatgaaaagtatatttactttaataataaggttaagatgttggagtgcatagagtaaaaaactagaaaagaaccagatgttagaaaggagatttcttaacaaaatacggttaaagaggatttctcatattttatatggaaagaaggaactttgatatttaagtaggaaccatcttctaggggaccctgttgattaaacaggaaatctagaaactagacaaagaaaaaaagaatttggctatatgaaagttaaaacttatattgcaaaagagaacataaaattaatagtccaaataaaattcagaaaataaaatatttgtaacagagatgccagataacaaatttgtatctataatatggaaacaactcttataatttgtttagaagataacccaatggataatgggcaaaggatatgaataggcaattttggaagatcaaatttagatggtcagtaatgtttcaaaagatgctcagacttattaactgttagtgatatgcaaattaaaataacaccaaactatcattttacatgcataaggttgtcaaagattaaaatagtcaaaacacttactactttggcatggggatgtgggaagtgatttgaatacattgctgttggaaatgtaagagttattttatctcttttttggaaggcaatctggcaatatttattaaaatggaaaatacacatactctatgctccagtaattccacttcaggaaatatatccctaagaaataaaagtactggtatgtacaaggatgtttatttcagcactgtttataatatcaaaaattacaaacaaaataatgcttattaatgggatgggtaaataaattatagtatattg

SEQ ID NO: 1894 - DNA, 2157 bp, Homo sapiens
cctttggccctctattgagatttacttgactcatccaagttcaaaattaaagagtggtattagttttccaaaacttcagaggtttgacagtgtcacttcaatagcagatattttctcagatactacttacctaggtaatgtaggtacttcaagattacctaggacctctaaggccaacctttttttctggcaaagctgcagcttgccacaacccacatcttgatttttctttctggagctaatatataagtagataactaaaagcagtaaagcagtagagtaactccttcttcttccagacagaagttctacatggacatgaaattgtggccttctttggtgcctggactaaaacatcctttttgttcagacccaagtgacatttcattaaattgatcatgaactttctatttgataaaaatgtggctttttagtggctcacaagtctgcagacttgattttaggaaagaggccactttcacagaactaccaaatattatcctaccttgaactgctgcccttttgctagccatatcttctaaactacctgttgtggatcatattggtctgtttgggctcagactttcacctttaaggttttgctagggataaaatgtaatatgttatataaccccaggctactgaaatctcctttgctagcatcttggtagcaactctctcattcatatggagaaattcttactaaaaatttgagtagccagcaaaagaaacgatagcattttgtttagaggatcttaagggacagtctcacatgctgatggagagggtagtcatgatgagggtatcaattcttgatactatcctcagtgatgttgctaaccccaaggatcccttagcagatcattattcaagccagtgtcaggttgtttcccaattctctaagtttgagacctgtactatcagtacttccaaataagagactatcagttatgtcctagttactcagagaatagtggaagataactccatgccctagctaaaagagacacaacaaggactgcaaagttcagtagagggctcaccagctctattataagtggttaactcataacttaaaattctgcttttaaagcagcccttcccaaagtatggtccctggactaagagtatcggcctcacttgaaaacgtgttagaaatgtaaattctacttcatatttactatgtttagcaagctgtctggtgattcagatgcacacaaaagttttgaaagcacggccttaatgtgcagtatcatccttcaccatgtaatatacaacaagtagaagaaaaatctactgtcctacaacagcattgctccagggtaattcaatgaggtattgaacctgaaagatgatccaaataaagaggtctattgttgaaatttgggcaacatgtataaatatgtaaaacataaaattgctctcatataatcacttgaggttgggaggtaggtagctgttataaccatgaaaagaccatttcagtagtttttcccctcctgttgaccctaaagctggcagccaatcttgcgtgctccccaaaccagaattattaataattaactgcttcccaaggattaacagaacaacatacctggactacatactaggactaaagagtcttcacttggttgtgttaatttcttgtagctgccataagaaattatcacaaacttggtgctttaaaacaatagaaatgtattctcttacagttctggaggccagggctctgaaattaaggtattggcaggatggtggtccctatagaggttccagggaagatcccattccttgcctcttctaatttctattagctgttgatgcttcttggtttgtggctacatcactccaatctttgcctcctttttcacatggacttctcttttgtctctcaaatctcctgtgtgtgtctcttataaaaggttacttgtcactgggtttcaggcccatcagatccagggtctctacatctcaagatctttaatttatacctataaaaaacctttttccaaataaggtaacgttcatgggttctgggaattaaagcatggacatatcttttggggggccaccatttaaccaccataccatgtggtagccacctgcatacttatggtacttatggccacagtttttggactagagagatatggggga

SEQ ID NO: 1895 - DNA, 3501 bp, Homo sapiens
agatgcttcacctagaatgaatatactttttccaccttttcctcaaaactattgccttctattagtgttctgtcagaagtagctctctggtacaatactaaggtgcaagtataagctgatctactttttaaaaaacagctacggtggcatctttaaggggttttaagtcagccataaggagtattagaccaatagaggagaatcagttaaacaacaggaataaaaaaagggaagggttaaggaacttaccgaaaataaaggtataggaatttcttcctttaaaatttatttaaattttggaaatatggggtaaaaatgagtcagtgagcaggacgtttaacttgacaggcaactttatagttgcaaaccattttaaatttcacttcgactttccattatcccttagagactcgaagacctaatttagactgtctggctacactatcacagggggatgatttgtgcacttagggtatcccttggggttttctacctgtttggaaattaagatgtaaattagtattgtagtatgttagaggggtgtactggcaggcagttaatttccttaggtgaaattaatgctcagagagaaatcgtacttacatattcaggttaggctattacataggcacttcaatggagtgaaattaccttttcttctatttcatacaagtgttgtacaacacaaaaattacataatcttccatgttaataattactaatgtcaccttaaaatattgtatgctattgaatgattatgcatttactggaaatgtataccccacagggtatttaccaagtttctctatcaggcatcatcctccctcttccgccatacctggaactgctgtgttcctctttcactgtagggactaagtagatatgtattaatttttggattttcttatatttagatagtttttgaaaattttctttttggtgatcactgaagttctctgttagagacctagtggcaaaagttattttaactttgtgcttagaaaataaggacactcttcacttttacataaatataaagaggatgcaaacatcaagtacttcattaattaacaagaaaacttttagaaatatcatgtgttttgtcaccacaatgtgtggcacaatgccagcagatggcataaaaagtgtttgaaacgtgatgtgatttggttttgctttcagaaaactaaacagtttctctttggattgagcatagtatcttcttcatgtacatgtcatggattgcttagatagtttttacaagttcgttatctatctcgtaaagcccacattattgtagtttttgatacgtatctctttatttcatcattttgacatagccataaatggtatcccacatagatattcaaacaatgtaccattaactaggacatagaaatcctagtcattagctaacatgaccccacgtggaaatacaccactttatggagtggaagggcaagggaagcagatgggggaagaagtatgctcaaaaaatagaaaagtatatacaaagaaatacaagccatgaggtgaatgataaccaaacagattttttttttaaataagagaaaaaacaaaaagtaaaacagcctagatgataacacatttttgcctggtccagcctttgggaaaccagattacattctttcatctcatagtttcatgggcatgtatttttaccagggaaagagaatttgtacatgataatatttctaaatcatactctaaatcattctctgtactttcagaattaaatcttggcacacatgtagtaagcctacatgagaaggtgcagttccaatacaactgagtggttattattaaatcaagtagtgaagatccagttgtagttcatttgagagcaagattctgtgaatgctttaaatgtattaacagtggttactttgctctgcaatggcttacagtcaagagaggggaaaactaatgcatataaatattaatacatgatgatacaatcaaatactaagcacagatataactttgtagagtgacctagagaagatataattgattttgaagggctgaattttttaaaagggatcttcagctgggtttataggtaaatagaatttatatagccacaatagagagttagaggtacagaaagaaggacatttcttgaaaggggtctatggaaaccaaagcacgcataagggaatgaggactcagaagttgagaaacctgaacagagggtgcgggacagttttactttggatctgtattctgcctcttcttttcttccttctttcttagtcttccactttttttccctacaaatatttgttgaattacttgtatgtgtatctgttctttaactgtaagcagaaacccagttcatcatgagatttttcattctctcttcatgcacacagaatagttacatagatatatactgctgtgaatgtctgtttcaaaagctcactttaatgaaagtctgtttttgtcgtaggttttatgaaaagaaaaaaataaacattgatatctgaacacatgggaactagatgttccaactcaccctcttgatgtctgtaattattttattttggcactaatattaccaagcttgtttataattaaagataaatgaaatagtaaaattaactactttatctccttatttaaatttcagatgggaaatttggaattttactgtttaagtcctttgttaaatatctaaaagggctctactacagggagacggattaattaaaatcaaaattgttgagggaatataattaaaaacaaaatcttataccaacccagaaatcccctccaccaaagtaatagaaaaagaaaacacttttactattaagcattaaaccagaatgtgatgaacattacaggcaatccactaagattataaaaaccaaaagaaatctcacttttctatattgccaagtagatgtagccaagagtgggattacacacatgctttcaagataaacaacaaccagtcctcaagtaaaaggacttgacagccccatcctaaattcttcaggtaattggggtgatcatctgtgttagctaattggctttctctgaggagaaacaaatttctcatccctttatgacaggaagaagttttgcaacttggagcaagggtaaccctgaagttaggctcctaccctcccataggaactgggagataggggagctttctcccttgatgtttgcatttcaaaaagatagcctcaaggttcttgagaaagcatttctgagttgtgaggctaatgggaggcttagttagccatcattaagatttacataaattctcaaagaacaaagaaagaaattctaaaagaaaagggagggtagaaagcagtctctatctacccttgttttcagcagagagatttgaataagaggtatatttgtccttacagtgtaaaatgaaggaaataattgttttttaagaaaagtagtcagtggatattttgggttacctgagtatattgtcagtatattctaaaacaaata

SEQ ID NO: 1896 - DNA, 1381 bp, Homo sapiens
gggatgcctcttaaattcataaagggaatgtatggttgaaatagcagatcagaaacatcaggaaagacatttgagttggatccatccttcaaagctctgcaagactctgcaagctgtattctagcacttgcccactgggtggagccaatgagctgttaaaaaaaaaaactcgtttaaataaacaaatggcaatgctaggttccatcgctttcttcatcagagccctcccgcaggctagcagggccaaacacattccttcctctctgagagtgtggccaaaatagcttctacccagggtgctctttacaatgaatttgccattgctggagttactgaatgccctgtgtattaaggcaggccactaaagaactccaaaacgtgtattaaaaggcttccgctgaggtgatgagaagcttctgagaaagttcctggtgactgtgcttggcttgtatatgaagattttcaaaaacacctgaatttttcaaaatgtgtttttaacagaagatcaaagtagaatcttggttgtggtcactcggtttcatttgttttaaaataaagcagtaattgattctatgaagtccctggttctccactgtcaacaaaacaaattccatcctctgaagcctgtcaaagaaagaggacccatcgccccctgctcacctcctgctgaattccctcccactcaccacaccagccaggcaaactagacttctccaggtctccaactggccagtttctagtggtttctttcttatatctggtaaatattttctgcccttctctgcctggcaaattttgacatcctttaagatgcaattgtcagctcctttcttgggtatctccatcactttgcacacatttgcattctatcacattggaattcatcatttcatttttgcctgaatctgagaagaacattaatattttttagtatattaatgtatgatgcatattttattcaaattgtataacaggatgtatggtttgatccagttattttgagaaaaaatataaagaaaaatatgggtccaacatgataaatttatctttgggtgaatacaattgtgtatgttttctgtttctaatttttttgtcctttgcggagtctgaagttttagatatttttgatatgcatgaatttttttctaagaaaacaagaccggttatttaaaaaacaaaaaggaaagtagacagagactccaatctgaaatcatatttcactttagaaatgaagttaaaatgacatttgcctagtttttgtggggacggtgggggtggatgaaatcagcctgtcttttacataagatactcaattttttctgttctgatctaaacactttttaaatttaaatcttctttatgtacttgttagcagttggaa

SEQ ID NO: 1897 - DNA, 1910 bp, Homo sapiens
tctctgaaaaaacttctaatctacaaatgcatgctttgtatttcaggcagacattgtagaatgtatttacaagaataggtgactgcctacacaaattcttttggtctaatcataaaagtaatattgtttaaaaattagaaaatgttatcattatcacccataatcccatcaagaaataatcactggtaatattttgttgtgttatcttccagtcttttttctgtgtgtgtatgtatatagttttgttaaaagtacaattagagtcatactaaatattcagtttgtatcctcctttttgtacttgacataagtattagatattctttgaacaatgaatcaccatataaccatcacacagactcagcaattatcaagacaaagtaatacttagatgcctcttcttgtacatatctttgacagttggtcctgacaattttccttggctaaattcttaggagtggactaaatcccatttacattacattttacattaagagttcatgaacactttgcattatactccacaatagatgtttgtttcatagaaaatattgaaatgaaatgaatgagcactatttgtcttgcagtgttggtacccgttgcacacactgagtttcccagaagtatgcatgctgccgttagaaaaaaatggacacaggactcaagaaccaaagctataaaaaggaattagtagtcttcctttgagtatagcagtggttctcaaccctggctgtgcattagaattatccagggaacataaaaaaatagaatggcagtgtctcacactagaacaattgaatctgaagttcctcagatgattctaatgtacagccctggttgagaaatactggcctacagaagtgattctttaagtgtggtctccggaccagcagcaccagcaatatctgggagcttgctagaaatgcaaattcccaggcctcaacctagcagcactgaatctaacacttggggacaagggtccagcaatctgtgctttaagatgtcctccagaaatcttgatccatgacaaattttaagaaccacaggcctagaatattcctggctcaaggatctagcttgcttaaccaagtgggaagtctggctgaagatttacagaatctggtgtctgacttgaactcaagtctctcgtctcccatttattagctacacgatcttgggcaaatgacttagcctctctgaggctgtttcactgtgaaggacataaggatcttaatagcatctaccttgttgggctgttgtgaggattaaagggaaaataatgaatggtattttccaaaaggtagaacttgataaaatttgctattttcattagccatcagagaactattactgtggtcaggagatcaggaaggaagcctccgaggtggagggagacaactgatctgtcagtctgaacacccaaaacagatgtttgtttcctaactcttttccaggcctaggcttggatttagattacacctgctgtgacacaaatacatgaatctcccaggatgagacgatgagtcattctctcaggagctgtcttcacactacggaagtgctgaaaatacacggctagagagccgggcttggtcatctggacctcaaaactgccaggggtgggaggaaggggagaagggaggggaccacccttctaacacctagaccagtgttctcaaacgggagccctgagaagcacctggagtgctcactgaacacagactgctgagctgcacccccagagtttcagtgagtctggggaggggtctgagaacttgtgcttcaaacaagttcccaggtgaggtttatacaaatctgaccacactttttatgctaaattgaaaacactggcaaagttcatgaaactgcaaggcaactgaactgtgacctataaaaagttttaaaaacta

SEQ ID NO: 1898 - DNA, 16545 bp, Homo sapiens
agagtggatctttaactgaatagaagagattgtgttttgaaaatggaaagcatacaggttatttttgttttaggaaggagacaccatgaatatctcaaagctttagagaagtgaaattcttttagaaaaacaacgttgtgattaaacaataaaaacaaaatataagcaccattcttgccatggtttttgttatttctaatacaaattatatgtaatcatcaagctggaaagggcactaaagatcttttagcctaccttctttttttaggtgagtaaactggagaatatagagatttttcaagaactgggaagggtctgagattttaggctatttgcaaactaactagttagcttgtcacggtttcatgaatgctggtagaaaatgcaagactcctggataagaggtgaaagacagtttcttttttctttctttcttttttcttttttgagacggagtctctgtcatgcaggctggagtgcagtggcgcgatctcggctcactgcaacctctggttcccaggttcaagtgattctcctgcctcagcctcctgagtagctgggactacaggcatgtgccactgtgcccggctaattcttgtatttttagtagcaaagggtttcaccatgttggccaggctggtcttgaactcctgacctcaggtgatcaacctgcctcggccttccaaagtgctgggattacagacgtgagccaccgcgccaggccgacagtttcttatacacggaatgacaataaccaatgtatcagcatctgtatatccaatccttaagccccatttcccacaggggacataaagaaggctccctgatacatgtacaggcagagctgcatggcaggaggagagccctgcacttaggacccaggaccttttccaatgggtagaaggcaagtcggccctttctcctggagggtgatttatctttattacactagagagtaagcaagctatcccttttctctagagggtgatactgcctctatcttctcaggctgtttgctttccaaacaccttcaaaaactttatccagaacacagggcagtcagcacttcactgtcaagatgcacagaaatgtgagagattcatagagaattatttttcagcagggatgagtcacttgtagaagaccacacagttgtcttcaagctgagggttcttttcacatcattatgctgtttccccataaatacctgaagccacatcagcattttcatgatgcgtagattcctattttctggaaatttgttttttccattggagaggcaaactttgaaatcttcataataagattcatgaagtcaagacagtttatgctgtttctaaatatccaggttgttttactgcctcccttgcttctgggatcagcattggcatcccagttttaccttggatagaatgtggcctggcattgcttaggctgatggaggcagtggaggtagttaagaaggagatggaaccaaatgtccagtaagtctgaatacaaggtaactcagcatcacagatgattttcctgttttctcaatttttctaatatttgtcaccagtctaaatgtacaaagtcttagggatgtagatgaaattctgtggcttacttacaacacttaatttatgactttaattacccatacatacttcaatcacatatgcaattatatggtatgttagtgaaattgctctttctcccgtctcctgaaaaagtgttactcaaattctacacatgcatttgcgacatttagagccattttggggccatctgacgtggttttccaggaccatcatttctacattcatattaagtttatttttaatacagcagctgttgtttctgtgcataaattttatcttaaatataaatatattagaaagctttgtttttacatctgtgttgtgaatatttcatgatctctaaaaattaacaatgtagtttgtggcttttaaagacaatatttaaaaaccttgtgaatagtaacttccaacggtggcaggtataagggcataaccctagcgagtaatcctaaatccaggtcacatttctttgccccactttctatcaactcatttaactgagctccagagcatctcaactagaattagcttagggcatttcaagataatgcagcttcttcaaaagaaagggtcctggaccataagtcacttcctaagaacttgaatatagaaaaattccctttttactaagagatgatcctcacctgattatgcatgtgatattagcttaccttaactaagtaatttacaattctaatcccattttttctcatcaaaataggaaaaatgtatatactgctggtgtctgagagtagttatgagtgttagataaaataatgaatatgaaaatctacaaaccataacttacatttgtttatgtatttgtttatgatgttcctcccctgtcattctctatcttgattgttggcacccatatccacccaggcacctaaatttcaaacctggaaagagtctttgatttactccccctataaaccattatcaagtcctgccaaatttttaccttagtatatcctcgtctttatggtcctcttatcctaactattgccttgttctggctttaattcattgtgtcttggcaggctctatgatcacctgagagcctctttttcacacagccttcagagtaatcgacataaaggtgaatcaaattgtgtcactcttaaaattaaaatcttccagtggttgacatttgcctaaacacacccaaagtgcattcagtaattccaagttctataaagaaatctcctcttaataagtaattccaggccaggcacggtggctcatgcctgtaatcccagcattttgggaggccgagacaggtggattgcttggagcccaggagttcgagaccagcctaggcaacatggcgaaaccatctctacaaaaattagctgggcatgatggctctcacctgtagtcccagctacttaggaggctgaggtgggagaattgcttgagactggcaggttgaggctgcagtaaactgaaatcatgccactatactccagcctgggcaacagagtgagaccctatctcaaaaataaaaaacaaacaaacaaacaaaaaaggcattccaggaccaggtgcagtggctcacacctataatcccaatgatttgggaaactgaggccaggagtttgagaacagcctgggcaacatattgggaccctgtcccctgtctctacaaaaagtaaaataaaaagattagccagatgtggtggtgtatacatgtaatcgtagctacttggcaggctgaggcaggaggactacttgagcccaagagtttgaggctacagagagatggtgccagcgcactccagcctgggcaacagagcaagattcttcctgtcttcacaaggaagaaaagcattccataatagaaataattagaaattctgtgtaatcgaaatttttattgctgaaaaactcttatttgcatagtaaggccttataggagtcctagaataaaggcatctctttgtttccccaaaaatgtgatattcctaaatgaaattttttttgtttggcaaaacatctgttattgctctgagaaaggcacacatcaaaacgcaagcccataaaataaagcccaaactcctaaacatggtccagaggcttcctttcatgacctcgacctgcctgtttctctctctgcctttgacctctcctgagcccccaaccccaagtgctcgtaactgttagcagagtttgcaagaaaaagagagatatgttggatgtcctccaaaattgaggtgtagtctacactcttaaaattgtagtaagttgtaatatttattagttataatttatatttaaaattgtttttagatgataacatatcaccttatctttctctttgacacatgtagatgtcatcaggctatttgttctttggaggtagcacatacattttaaaggactaaattcaacaccaagattgaaattttggttgatattttaagagtcagtatattggcataccatacagattcatatcatggagataacagatgggaaagcggcataaggtatgcctaatttatcaaacctaggtagtgttcatatctcaggcatgcatatggaggaaaggcctgaattatgtcactgatagttttaccaagaagtacttacatttatgagattgagagttgaagctaattaatgatcttatacctttttttttttttttttttagtactcaaaagatccaaagttagtagtttgataattaggctgtacttcattttcagacagaaattagacatgattaggaatgctgaagcactgggcaggtcagttgctcatcattattaaagccatttaatgcattttaatggtggttgataaggtacaaaatgctacgtaagccaaatgaaaaagttttattccattatatgttaagcgtagatataaatgagttcccatttgcattttttatgcattagttcaaaaaattaaacatttctttcttatatatgagtaatagaatgtgtaatttgtaagagatgggcactgctgaagccagcacctcttcacactgtgcacctcaggattctcagacacaaattgttatgtaatagaaaattaaggaaaagatcttttcagcatttgtgtggctgaagaatcgtgctttaagctctaagaccaattgcttgtgtaagtggctcacatttattaataatataaaatgataatctaggtctactgtcttatttatgctaggcttacagactttgttaatttatagaggtaaacaaacaacaaaagagatagtgcatagtatagtttctggtgaatattctattttgttagccatgttttgaaaatattctatggccgggcgcggtggctcacgcctgtaatcccagcactttgggaggccaaggtgggtggatcacgaggtcaggagattgagaccatcctggctaacacggtgaaaccctgtctctactaaaaaaaatacaaaaaattagctgggcgtggtggcgggcgcctgtattcccagctacttggaggctgaggcaggagaatagtgtgaacccgggaagcggagcttgcagtgagcggagatgtgccactgcactccagcctgggtgacagagcgagactccgtatcaaaatatatatattactagttcccatctactttagagcaattcttatattttaaaattatttttcataaataacttagtgttgggatttgaggataccaataaataccatcctttttatgtacctggtttagaaaccattgagacacagttacagacagatggagatcaaaatattccttttgttaactgataaggagctattggggcttgtagcttatatgtgatgtcaggtcaagtggatctactaacacgttctgatacacaggctaacctgaggatcagtacttgggagggaggtttgaacctgcagagcagagagacttcctcaggatcgctgcctcgctttggtccaagggaagaggacagatagagaccatgtctcccatgctccactcacatgagaggaccaatggctgtcatccaccaacagatagctcattccactactatgaagagtactaagaattagacaagagccagaacaggtcttttgttggaagccagagtaatagcagcaagcaccttttatgcttcctaaacctcctgatgtggacaacacatgtagtttatggtagggctacacagacagcacactaattgatgatgccactgccttgtattgtcttaagggaggcaatgggaaacatagtatgtctttattctatttcttgtgtaaaaagtagatggaaatggatgggaacatccttggttgaggggacagaggttgatttcaaggctcttattacataaacggtaaaagaggagaggtcctggtgttaagctcatcagcgtccagcaacctcagccacaatgtgtgtctctgacctactcagggctgtccacatcagaaaactggagcataagacagtctctctccaaatgctcttgtcttggaggtgttcccaggcttcaccccatgcagccacccaaagggagagactgccaggaaggcggggaggaggcatctgtcctgattattgagtcaccaggtagctattagtggtcatccctggttcttcctgtgactgtgtgcacattacatggaatctccaagtggatgggctggttactgattgagactcctaagaagattgtgtctaaatccctgattatgtcatatcaaagcaaatggtatcaggatataaccaggaaggtttgttaaaggtgaaatcactgtttcataacagcttttgaaggcataagaaagccaaaatagttgataaatctcatggtgattctggacaagcaaggatcttcactgtcctcttaatgaagtgtaatgcaagtagctaacatgtttagaatgtgccaggcagtgttctaatagcctaacatgaattaatgaatttaaagtaaattagttcattttaagtctcagaaaagcccatttgggatgattactactattattctgttgttttgaggtggacagttctgtagatacctgtcaggtctgcttgattcagagtcgagttcaggtcctgaatatctttgttaattttctgtctcaatgatctgactaatattgtcagtggggtgttaaagtctcccactattattgtgtgggagtctgagtctctttgacaatctctaagaacttgctttatgaatctgggtgcccctgtattgggtgcatatatatttagggtagttagctctcttgttgaattgaaccctttcccattatgtaatgaccttctttgtcttttttaatctttgttggtttaaagcctgttttgtcagaaactgggttttgttttatcttcctattatgaaagagggaatgaggttcttagagggctaaatagcctactgacattccccagctaaaaaaaaaaaaaaaaaaaaatggcagaaggacaagagccatctctacagctggagcaccaaacccccgcatcacactgcttatcaccaacgcagtagaatcactggtgattcctactaagctgagtccaattctagaaaaaaatctgtgacttgtgtttgtttatttagttttaaaggaaatacaactaataacatttattaaaagcaatttttagtgttggatttgatttcagcaacattttagcaaatgctcatttctatatgacctgatcttatgtttatggatgatttgttttgctttgcctttgaagtttatatttgaagtgctaccaaatttatttagttgtttacttctttgtgtgttggtatttccttccttccactaatagcgtaagctctgtgaaagaagtgctcagcaatagtaggaattttttaagtgtttgtagaatgattaaaagaatgaatgaatgaagttaaaaagttaattgtttatttagcttatagtgacctggtatctttataaacatagtctacatagtcttaaatggagaactactgttaataactcaattgttttagaaagatgagacaaatgaattatttaaaatccttgcaggtctatgattttgttaaacgaaatgtacttaatgactcatattcttcatataagtgtgtggttaatgattcatatttttaacacaagtatgtacttatttatttttaattgatgtaaaatgaaatgatcagtgaagagttgtgtttaaaaatattttccttacaattcccaacagctttaataataagcagtctcatgcttgtttgtttttaactccagactttgtatatatgatttcctctccctataatgctcaatgcattccccttcatcttattagctcctttttatcatttagatattagcttccacatcttttcctccaggaaacatttctaggcccttcaagttgggccaagtgtacattctctgctacctctctggctgccttcataatgcagtgtagcttactggtcttactggatggtttccccaaacccatattgttctcgatgttaagactctctttagcacctagtacaggagcagacagagaaaaacataaatattgaatgagttgagtgaataaatgaatgagcatcaataactaagaaagtgggcatgctataagaattattctcaagtaacagtaaatgagtttgtaaaacagaataggagccccaggcaggaatcagagggacacatttagactgccctgcatagctcaaatggtcataatggtttcaggcattttgaaagctgggcatgtatcatcagctcatgccacgtaatttccaaccttctatgccaatcccagaagcaaggagaatgaacataaaaccagggaaaatgaataagaaacacttggtgaggaaacagcaactgcaggaagggcacagtgagccaaatgtaaggacagtttcccaggtgggtggagaaacccatgagacattggaaactgtaagagaagcaggcaagagaaactgcagaacccaagagaaactgcacagtacaccaacagcagcaaaagtgaaggacaccacaaggtagtgataccacaaggataaaggaatagtggaggagagcaagatagtattgctaaaagaaaaacttcagccgaattaaattcaaaggactttaattgagcaatgaaggattcaaaaatcaggcagcccccagaatcacagcagattcagagagactccaaggatgcctcatggtcagaacaaatttatagacaaagaaagtaaagtgagatatagaaatcggaagtgaggtacagaaacagctggattggttatagctcgggtttgccttatttgaacgcagtttgaacactcagcagtgtgtgactggttgaaatatggctgctgggattggccaagactcccgagattaaggtaatgttacaggcgtacactcctaaattaggttttcagtcttgtctacctattaagttaggttgcagttcatccacaaggactcaaatatagaagtatggagttcttctcagtccatacttaagtttgctgtaacagtatgactagtattatgtgcagagggcaatacagctctaagagaaacagttataattgagctctgttctgctgcagtcaatagaagtttcctctgacacatacttggtaacgctgttacccttcgtttgcctttgtgcatacctaagacatcttccaggacttttgattctcttgataatgagtcagcatgatgatgggccagggtcttgtaaggagagctcactttttggaatggatcttcctctagctttgttattctcagctcagatttcatcctgcctgagcccttatagtagaacagtaggtagctacctaacaacgtctgagaccctggacattccgcctttctcctcaacacacagttctttaatgctaccctgatagctgttttcttcaaggacttaggtgaagctgcagactgtctcatcaaatgagtgtgtcatcagctctctgacaacatattgtagagtgcttctcaaatgttaatgatcattattggggtcgataaaatatattattcaaaaattacaatacaaaaaaagtatgttacaagtgccttaaattgtcagagaaaggagaaataatttatacttggagtgactaaacaaaaactccaaggggattagatgaaaattatgttgtttctgtccaataagctaccccttgagcaatctaacatttatcataaattctgttggtgaatctgctatctcagtgactagctctatttgaaagaaaaagatagtttctattttcaagcagaaaaatatgaattacttgtctaaagtattaatagaaagatgtttaatcagtccttagtctctttctattgtgcaatacagatgagaaataatttcaaaaacgatgtggaaggatgcagtgtgccatgctagggtgaaatggttacccagaaggcatctcttatttggggttccttctctgtatagatgcttatgtgagcttaaattttttcatgtatgcttttctttaaagcccatcagagtataagaaaaactgaatgtctgttagccatattaatgagtgaatgaatggtttcctgtatgtgttctgttgtaggtccattaaatgaaagcactgaaacaaattagggctttacttaatgtgtatattaattggctcaagcctattaacatacaaaaagttaattagcaagtcaggacttgtagtaatgtcttaaaggtggttgtaaaacttatgtaaaagactttttctccaaaccattccacttctctaacttggaaagtttatgtaattatgaaatctgatcctaaaggatgtagcaaaaccagtggtctttcttactaaatttgttggccctgcacctagcctccaacatttttataatggtgcttctctttcatggagcttcaaaagtcattacaagaaattctactcctttgttcttccctttttaataattaaaaaaatcatctggctgggctgggtggctcaagcctgtaatcccagcactttgggaggccgatgcgggtggatcacaaggtcaggagaccgacattctggctaacaccgtgacaccccatctctactaaaaacacaaaaaattagcagagcctggtggcgggcgcctgtagtaccagctactcctaggctgaggcaggagaatggcgtgaacctgggaggcagagcttgcagatcgcgctactgcactccagcctgtgtgacagagcgagactccactacaaaaaaaaaaaaaaaaaaaaaaatcatctatgggatattttacttccatagtacacttaagtttttcttgcctcaatcaattaaaatatacatttgttaaaaacctttatttgcagagtaattgtccaagctgccctttaggatgaatcagtagagcttaaagatgatttgttacaatattaaatctaacaagcaactgatttgtaattttctaaagatattacggggtgaagaatcaaaatggacagcatctagaaatctgtcaaaatctagatgccttcttattacaacttacttcattttaatattgggaagttagcttaacttcaaaagattttgtctcataatactctattattattagtttgataaatttcaagtatacagaaaagtatagagcaaatatcccaaatacctgtgtgtcttttgccagtttcattctctcctgtcttccacattgcagcatttggtgtttattttttccaataatctcttagtgtttcactctatagttatagactcataaacaatatggtattgtttgcatatttaagctttatttaaatattagtacataaaatttaaatatgtgcagtataacaccattattgctttttctgctgaacataatgtttttgatatttatccatattgttgtatgtagtgctagttcatttactttaacttctatgttgtattctatatagaggaatgaacatttatgttgtttctaatttttattcttataaactcttgccatttatgcatatcatcttgtacacatgctacaagaatttctctaagcttatcggtgtgaaattgctaaatcatagcatttgtgcagatcttcaacttcactaagtctggagctttcagtttgcacttatccctccaggacatagactgcatattgcactgataccaatcagttctttctcactataaaattttttttttaatcttttgagtgtgaagtgatatccagttgttgacttaatttgcatttgtctgattagtgtgagcttgagcatttttgcttatttgctttatgtattttttaaaaattttaagggtaatactggcctcctaaagtaaatttggacgtattccccccgcttgaatttttcaaagtttaagaagaattggtattcgttcatctttaaatgtttcatagaattcagtgctgatgccatctggtgctgtgcttttctttgatgtaaagttctaaattacttattcaatctccttactcactattggtcttttcagactttctatctgttcctaatttagtctcagtaggttgtatgtttctaggaatttactgttttattttaagtcatctagtttgttggagtataattctttacagcagtcttttgtgattctgtttccttttttttttttttttttattgaggtggagtctcactctgtcacccaggctggagtgcagtggtgtgatttcggctcaccacaacctctgcctccagggttcaagcaattctcatgcctcagcatcccgagtagctgggattacaggcatgcaccactgtagttgattaatttttgtatttttagtagagacagggtttcactatgttggccgagctggtctcgaactcctgacctcaagtgatcagctgcctcagcctcccaaagtgctgggattaaaggcgtgagccactacgcccagccgcttctttctatttctgtggtatgttttaatgtctcctttgtcatgtctgagccttctttttattctagttaacctcactaaagtattgtcaattgtcaatttcatttttattttcaaaaaacaactccagttcattgatcttttctattgtttctctagtttctctttatctctgctctgatctttattttttctttcctcgtactaactttggattgagtttgttttttttcttgttccttgaggtataacacttggttgtttatttgagatttttcttcttttttaatgtaggcatttatagctacaaaccgccctctttgaactgcttctgttgtagcctataagttttggtgtgtaatatttccacttttgtttgactcaagatattttttgatttttctttcaatttattttttgactcttggttatttaggagcatgttgtttcatttccacatatttgttaatttttcagatttcctcctgttattgattctcattttgatagcattgtggtcagaaaagatacttgatattatttcagtcttcttaaatttgttaagacatgttttatatcttaacatatgatttatcctggagaatatttcaagtgtgcttcagaacaatgtgtattctgctgctattgaatggaatgttctgtgtgtatctgttagcattaccataataacaaataatgctagcttaccctgataccaaagccaggcaaagacagtgtaagaaaaaaaaaaatagggtgatgtccctgatgaacatagatgcaaaaattctcatcaaaatactagcaaaccaaattcaaaagcacattaaaaacaccatacatcataatcaaatgtgatttattttggggctgcaaggatggttcaatatgtgcaaatcaataaacattatgcattacattaatagaacaaaggacagaaaccaaataaacgtgatcaatagatgcagaaaaatgttataacaaaattcaacattcatttatgataaaaactctcaacaaattagatatgatttagtatgtaaggattgcaccttaccacaataaaggtgcaattttatatgtgataagcctacagctaatatttatgctcaatggtgaaaaactgcaagttttctttttaaatttatgcacaaagcaaggatacccactctcaacactactattcagcataataactggaagtcctaatcagagcagttaggcaagagagagaaataaaagacctccaaattggaaggaaagaagttaaattgtccttctttgcaaatggcacaatcttatatatagaaaaccctacagactctgagaactagtaaatgaattcagtaaagttagaggatatgaagtcagcatacaaaagtcagtagtgtctctacactaatgaggaactatcataaaaagaaagtaagaaaacaatcccattaaaaacagctacaaaaaataaaatacttaggaataaatttaaccaaggaggtaaaagacctgtacactgaaagctcagcaacactatgaaagaacttgatgacacaaataaatggaaagatatcttatgtccatacattggaagaattaatattttttaaatgttcatactccccccaaggagatctacaaattcactacaattgctgtcaaaatcccaatgatattctgtatataaatagaaagaacacttctaaaattcatatggaaccacaaaatacccaaagacaaaaaagaacaaagcttgaaatatcatagtacttgatctcaaaatctattatgaagctataataatccaaaaagaatggtatttcacaataacatatacaacagtagacagaatagagggccaagacataaattcatgcatttacagtcaactgatttttgacaaatgtgttgagaacacacacagaaaggatcatctttttaataaatggtgttggaacacctcaatatccacatgcacgtgaaagttgtcagaatcaaaatgaaggcactggtattaaaaaccaccacaaatacagctagctggggaagggcatgaaggggggcttctccggaacaaatgcctgataacaagaactatcataaaagattctgcaaaaaacaccttgtgcaaaaggccatcacaaccttacacacacacataagtcttgtggacatctgcctatcatctgtttgtccaaactcagactggtatcatacttgttattaatacatgtagtcaaggataattatctcaaaactattatttaattattctcattttttctttaaaaactttttcttgttttttttttttaacttccctgaatatgcacgtggcttactatggcacatgtattcccattgcaatgcctattctaggaagaatattattttcttttagagagtctcccttgcagtttgttatttattgacaaaatggtgtcagaagttaaaccaaagtgagctcacctaggttcaataggtggctcctggaatcatgtaaggtagcaattgagccctttgcactcttcatttccatgagtcaccttttctgtgctggtaaatctcctctcagattcttttacttcttcctttgttgagttctttttaactttattcaagatctgatttggctataaataaggctgccctaaataaaggaccttgtatccgtcttaagactatgaaagttttttctgttgtttttgtggcaagccctttctggtataaagacaaatgtccttctggttaagtactctggtttttacagaatttacattgtgtctatgagggtgtcttttttggtgaattcacttttgattctgcataacaggtttaatatttgtttgatctgcatacctgggttaaaatgtttgtgagtattctgattttggtttcattttggttatgcatgtctgtaaatgatttgactccttttcccttgcatgtttctgaacatttccaagagcaaaaataaacattctaaatggtggacatggaatggccaacagagcagtcatactaccatctacaacacctgttcaaattactgacattccctgagagaatttataggaatgtctttgctcttgagagaataatgagaaatggaattggattcttaaatattaaggcataccaaaactttctctgactcctgatggctacatagattttcctcatgcatgttttcaaatccataaccatcagggggattatttgaactccccccaagtctgttgtttttttttttaagagaattgtaactatacagttaacagatagagccttccaggttctgcctatctcactgtttctttgcctgcctactttgaatctgctgacttttctgctgatgttgagataaacttactgcttatggcattccagccaagatagaaaaaaaaagtcttaaagaactttgagattaatgccttacaaagtacagtagttccatggcaaccaatacctagatttctttttgagatgttaattttggcttgcctaacagttccttagtgtgatgaagcagttagttgaagagttgatattttaaaataaaagagctatttaaatgtttataaaagttaccaaatcaacagtgtcaaattattgaactcagagaaatagtataaagtatctctgtcagcattgaaattgctgtatctgtcacacaaggtctagaaattgctgaagaaaaaaataataacttaaaaaaatgtataatttcttcctggccacattgactacaaaccagaccagcaaacaaaagaataatctgttagtagttcaaggatgcttggacagtttgtttttcttatatgattcagccagtcctacgcgaaatgtaaacatttaaaaatttaactccttaaacttgcttgaagctgaaaaaagaaaatgggggggaacaaaagacaaaaagcattaaaaaatcaaactgctgtggaaattgcatacatgtatatatacacatctatgcacacacacatacacaaacacatgatcatatatgtattcctctagtaatttgtactgaagta

SEQ ID NO: 1899 - DNA, 6506 bp, Homo sapiens
tgaaatttagagtcaattctacccagttatatatgttcaccttgaaattcttctaatttcttttttaaaaaaatgttatgggtatatagtagctgtatatatttatggggcacattagattatttgatacaggcatgaaatatgaaataagcacaacatggaaaatgaggtatctatctccttaagcatttatgctttgagttaaaaaaatccaattacattctttatttaacagttaaattattgactagagtcaccctattgtgctatcaagtactaaggtcttagtcattcttttaaactattgtttgtactcattaaccatccccacttccccccatcagactcccgctctggaaatcatccttctactttctatgtccatatattcaattgttttgatttttagattccatacagtgataacatgcaatgtttgtctttctgtgcctggcttatttcccttaacatgatgacctccagttctacccatgttgttgcaaataactggatctcattcttttttatggctgaatagtactccattgtgtatacgtaccacgttttaaaatctgttcatctgttgatggacacttaggttgcttcaaatcttcccacttttaaacagtggggcaacaaacataggagtgcagatatctctttgatatactcattttctttcttttgggtaaatacctaaaagtgagactgctggatcatatggtagctcaatttttagttttttgaggaacctttaaattgttctccataatggttgtactaatttacattcccaccaacagcatatgaggtttcccttttcttcacatccttgccagcatttgttattgcgtgtcttttggaaataagacattttacctgtggtgagatgatatctcattttagttttgattttcatttctctgatgatcaatgatgctaaacacctttttcataagcctgtttgccatttgtatgtcttatttgagtaatgtctattcaaatattttgcctattttttgatcagattattagattattattataaatctgtttgaattccttatatattctggtgattaatcccatcagatggatagtttgcaaatgttttctccagctttttatactgggacctatctctctctttagctctaataatatttcctttctatatctgggtgctctcacattgggtgcgtatatatttaaaattgttatatcctcttactgaaatgatccctttgtcgttacatagataccctctttgtcactccctatagtttttgtcttgaaatatattttgtctgatataagtataatgactcctgttcttttttggtttccattggcatggaatatctattttcagtctttgtgtgtctttataggtgatgtgtgtttcttgtaggcaacagatcaatgggtcttgtttttttttttaatccagtaagtcagtccatgtcttttgattaaagagtttagcccatttacattcaatgttattattgataagtaaggacttactcttgccaatttgttatttgctttttggttgttttgcggtctcttcttccttctttcttttcttcttgtcttcctctagtgaaggtaattttctctggtgacatgatttaattattttcgttttagtttttgtgtatccattgtatgttttttggtttgaggttgccatgaggcttgcaaatattgtcttataatccattattttcacgtgataacaacttaatactatttgcataaacaagcaagcaaaaagaaagctaataaaagttctataccttaccttcctatccttgctttttaactttttattatttctatttatattttattgtaattgctatgtcttgaaaagttgttgtggttattatttttgattggttcactattttgtctttctacttagaataagagtagtttacacaccacagttacagtgttatagtattctgtgtttttctgtgtacttattattaccagtgagttttgttccttcaggtgattatttattgctcattaatgttcttttctttctgattgaagtactttctttagcctttcttgtaggacaggcctggtatttatgaaatcactcagtttttgtttgtctgagaaaatatttatttttccttcatgtttgaaggatgtttgcactggatatactattctaggacaaaagttattttccttcagggctttaaatatgtcctgccactctctactagcctgtaaggttttcactgaaaagtctgctgccagacgtattggagctcctttgtatgttattcttttcttttctcttgctgcttttataatcctttctttatccttgatctttgggagtttgattattaattgccttaaagtagtcttctctggataaatctgcttggtattctgtaaccttgtacttggatattggtatctttctctatgtttgggactttctctgttattatccttttgagtaaactttctactcatgtctctttctctacttgctctttaaggccagtgacttagattttcccttttgaggccattttctagattgtttaggcatgttttattgttttttattcctttttctcttctgattgtatatgttcaattaggctgtcttcaagctcactaattattacttctgcttgatcaattctaatattaaaggaatctgatgcattctttgatataccaattgcatttttcatctccagaatttctgctttattctttttaattatttcaatcactttgttaaatttattgatagaattctgaattctttttatgcattatcttgaatttctttgagtttcctcaacacagatattttaaattctctgtctgaaaggtcatacatctctatttcttcaggattggtccctggtgcattatttagttcatttggtgaggttatatttttctggatggtgttgatgctagtagatgttcttcagtatctggccattgaggagttaggtatttatcatagtcttcattgtctgggcttatttgtagccattcttcttggggaggctttctagatatttgaaaggacttgggtattgtgatctgagctgatggcatcacaagcccagtaactctgtgtttcttgcagactcataggaatactgccttgattatcctgaatcaaatctgggagaattctcaggattttcagatactcttgttctcatcccttactttctccaaaacatacagagtctctctctctgccctgagccacctaaatttgggagtggagtggcacaagcacccctgtggccatcactactatgactttgctgggtcagacctgaagccaacacagcactgggtctcactcagggcttgctgtaaccactccctggctactgcctatgtttacttaaggccctgaggatctacaatcagcaggtggcaaaaccaactaggcctgtgagcttcccttcaaggtaacaagctcccccaggccctggatgagtccagaagtcccatctgagagtcaggaactagagtcagaaaacttacaaatctaccttgtgttctattgtattgtggctgagctggcactcaaaccacaagatatagttcttcccactcttctctcccctttccaaaggcagaggggcttcatgtcgtagccactgctaccacagacccatggggagtactgccagactacctctaatgttcccttaaaacccaaggtctcttaaatcagcttgtcatgaatgcttcctggactcacccttcaagacggtgaactcccctctggcccagggcaggtccagaaatgctatttaggagtcaattcctggaatcagggacaccaagagcctgcttggtgctctgcacccctgaggctctgctggtacctaaggtgcaagacaaagtcccctttacttttccctctgcttttctcaagcagaaggagtttcgccccatagccaccacagctggtagtgtgctgagtctcatctaaagccagcaagcctcagaggctcacctgaggcactcaaggtagtacctggtattgctgcttgttattcagagcccaacagctcttcagttagcaggtggtgaatgctgccaggactgggtcctttccttcaaggcaacagggtgtgcctaggaatgttgtctgggaggtaggacctcatgactctgcccagtgccctatcctgacgtggctgagctggtttcctagaagcaagacaaagtcctcctgaatcttgcccctcctctcctcaaacaaaaggaagggatctcttttggagtggcgagctgtgaagtgtggagttaggggaggggaggtgccagcactccttttgctgccctagctggtgtctcagtatgtcacatgacccctcggtccactgtctctgggcctagttcagcactagaactcacctaagagttgcagtccttgtggcctagactgcatttcaagtttacttgtagacacagagtgtagtagcccttagcagggaggtttgcaggcactcaaattctgacctgtggcatctgcaattcctctctggctagggctgatttagataccttcatgggcaggcatcagctgggtttggtctggttttcttttctgctctaacaagacagcactgagttcagtgacacaattgctgtgttgtcactcccccagtgcccagagctgctcttagcaccacactgctgctgctgccagggatagggaaagggtggcatctgtgattctagacttttttttaatctcttcagtgcctctttcagcaatattaagttgaagccaggtgctatgattgctcgcctgatttttgattcttatgaaggtgttttctctgtgtagatagttgttaacttggtgttcttgctgaagggatgatcggtggcgttttctattccaccatcttaccccaactctcctgaaattcttctaatttaaatgagaataggttatgtgaaaattcacatttttattgttgggaaaattctaattttgtgggtttttgcttttttttctgactctaacccattctccaataccaaatggaggtccaacaactccctttaattctgacactacctagagctagcatagaccccacaggttaagggctcagttccacaagactacgcctacatctcattccagctacaaatggggtctccagactactcacacttctgtccagccaactaaaaattcaggggttctctcgaccactcctcaggtttgataactccctaggatgactcacagagtcctggaaagcactttgctaaagattactggtttattacaaaggatacaactcaggagcagccaaacggaagaaagcccaggacaagatatgagggcgaggtttccatgccctcttgccagtgtaccacgggcagcactttgatgtgttgatgtgttgatttgttccaacccagaagcttcccaaacctcatagttcaagaggggtttttgtttgtttgttttttgttttttaagctttattacgtaggcatgcttgattaaatcatcgtccactggtgattcattcggtctccagtcccctttcccctcccacttcaggagtgaggctgaaagttccaaccctctaatcatgtggtttcttcctttagcaaccagctcccatcttgaaaagatccaacctcacggtcctcaaaggtcacctcattaaaataaactcggcaatatagtttggatgtcctctccaaatctcatggtgaaatgtaatccccaatgttgtagttggggcctactgggaggtgtttgggtcatgagggatttctcataaatggtttagcaccatcacattggtgatgtcctgatgatagtgaatgatttattgggagatctggttgtttaaaagtgtgtggcaccttctccctctctctcccttgttcttgctcctggcatgtgatgcacctgctccacttttctttctgtcatgagtaaaagctccctgaggcatcctcagaagctgagtaaatgcaagtgccatgcttctacagcctgcagaactgtgagccaattaaacctattatctttgtaaattacccagtctcagatatttctttatagcaatgcaagaatggcctaacacactcagataaggtcaaaaggagctccttattaatgataaaagacactcccattacccaggaaatcccaaggcttagaagctctgccaagaatgggcacagatatgtacgtttttattagaccacactaatcatgcaatctttaattactaacccattgagaaaagagctcttggaaggactctgacactaggtcataaagttaaaccagaatgagaaagatactgaatataagtgcaaagaacttgaagccaagtaaaaagaaacaaaggcaacagcttgaaggactgctgggtaccaggcaaatttactcagggagcttgtttcctcctaacatcagtctcccaaagagtgccctttct

SEQ ID NO: 1900 - DNA, 1440 bp, Homo sapiens
cccactgtcgatactttatcatcattactatcccttttagtaacttagtaaaaaagcacctctaggatctttcaacttactaaagacttttcctagaggaggagacaaatctgattctgcaaactttttttttttttttttttttgagacaggatctcactttgtcacccaggttggagtgcagtagtgcgatcacagcacactgcagcctcaacctccccaggctcaagtgatcctcccacctcagcctcctgagtagctggaacgacagtcatgtgccaccacgcctggctaaattttgtaatttttgtagcgacagggattcagcatatttcccaggctggaattcctggacttaagtgatccacgtgcttctgcctcccacagtgctgggatgatatgctgcaagccactatgcctggctggctctgcaaacttttacttctatgaccctttctttctcttggtttctccttgacacttctccccaatgaacccatggtgcaatatgggagttggtgccctaaaagtgactacctcctaaaatcactcacactcaattattagtaaagttcaaatgacaacttttttatgataattgtgttttaaaagaaaatctgagggatagtaaaaacaaaaaaaaaattcatgccagaatttcaggcaagcaccagttgagaatgtatttttgtgtgagcagggtgttatcagtaaggttcaacatgttctacataagggactggaagctctgcccgggatgtatgagggcaatcttgcctggcctaaaggttggactgtaggtagcacaggacttccgggtttggagatttagaggataagtctaggcttcacccaaataccaacaataagaacttgagtagttcctgggacctccctgagcctaagtataaaatgaggacagcaacacatatctatactgccatgctgttataagaaataaatgagataagaaatataaagccttaggagtcaatacagtgcaatggtggagcatgagtattgcagagtccgattggttgggttcaaactctggacctgacactaattaagggttaatgaccttgtgtaagcttttaatctctgtgtgcctcaatctctctatccatatgataagggatacaagacctttctcatacagtggtttaaagatgagagtaaataatatatgtgagaacacaaatagaagagcatgcatatgaatagcatttaatgctcagttaatgaggctcttatcaaagtgacagagggcctccatgtaatcagagaagggtccacttaaggctctattggcatttgctgaaggatcaagacttgctgtattcctatctatgaatagacctatggaattaaaacccagtacaagcattttttttttctacttatatctatgtatgctctttctctcttgccttcttgata

SEQ ID NO: 1901 - DNA, 6086 bp, Homo sapiens
tagataccaagataagcaatagatttaggttttttgatggaattctagtggatgccttggctctctttgtcctggatctagggacactctagtcagattctcaaattttttcttttttcttttttgcacattcatggcttgaataagggtaagagagcccgggatagatgctaacaatctttcagattgttatctgaaatagatatcttgagatatgctgttagtattttcttcaaggcatgccatgttgttagcattttcttcaaggcagcccatgattaggccagaggaggaggatgccgctattcacttctaacctccatccttgaattatggtaaatacagaagatgcttgctggtcagaagagagttgactcattatgtcaggtagtaaaccaaaaattttctccctttatgatgaaagaaaacgcagataaaagcatgaccaataaacaagccataagaatggggaaaacagtgatgacacggggttagtgctatagaagttcccagaaaggtgtttgaaaactctgggcctataaatttaattatgtactattatttactaatattatatactaatatttactttgtttggaggtagaaacgctttactatccacttgtctttagtgtgaacactttcttaggaagcattaatgaaacacctaatactacctgcttccatggcagtccaaaattaagctctaaagattgaggagtcagaggtaaaggtcggtaggtttttctgtggtcttgacttcttctcaagatatctatttgatttccagtaataggaagtggctcccaattacatctattcccagggtccctccctattctcttgtcatcttgatttcagtttggcctgattagatggtactaagttttctatatggtaatttatattacaagaaaaattggtaaatggtgggatactgcttcaaatctgcagcaatataggtaggtgtctttggtgaggttttgtttgcaattataggattccctagatggggactctttcatgaaaaatcataacagcaagtggttgaataaaggttatttctagactgttttctccagactaattagagtagtacaagggccaaccatacagcctcatagtttcaagggtgctttgggagtcagatggacttgagtttaaatcttgcctctgccacataaaagctttgtgagcttggacaagtcatttacttctctcagcctcagttttctcatctgtaaaatgagataattatggcatcttatagaattgttgcgataatttcagatagtctaaatataaagcatttggcaggccaggcgcagtggctcacgcctgtaatcccagcactttgggaggccgaggtgggtggatcatgtgaggtcatgagttcaagacgagcctggccaacatagtgaaatcccgtctctactaataatacaaatattagctgagtgtgtggtggcacacgtctgcagtcccagctactcaggaggctgaggcaggagaattccttgaactcaggaggtgggggttgcagtgagccgagatcatgccactgcattccagcccaggcaacagagcgagactccatctcaaaaacaaaacaaaacaaaacaaacaaacaaaaataaagaaataaagcatttggcacagttcttggcacttagtatctagccttcattattagtcttagatggaaaactggatgcctcaatagacctggccaggacagcattcccacagtctccatcaagtcagcaagctttatcagctttatctctgatatttctttctagacagttcctctcctttttcatcattaccactactgctgtagacctgggcactaccttctcttagttggattttttggtaatacttatacacggttgccatgtagttctcataaaacttgttttgttttgttttgttttttcccccactgctcaaatacctgctctagatccctggtcctcagctttgtacttaagactatgatttggtatgagccagttttatcaatttaatcatctattttttattttcttcacgcatttctccccaaacacacatatcatccccaagccaataataattcctttcaaagtactttttgtacttttggtcttatgtatgtcatgttgcaatagcttttcaagttgattttcgtgtgtgtgtgtgtgtgtgtgtgtgtgtgtgtgtgtgtgtgtgtgtgtgtgtgtgttctcttgctttcttttagttcattccctatgtgaccaccagattaatcttttatataataccaacctgacctcgtcactcttctgaaccagagcgatttcctagtgcctttaggatcaagttaaaacttctacatcagctggatgcaggaggtcttctggggcatttttcagcctcaactcaactgtcactcccactatactgtgcaattcaactatattgattgctcttgagactacacatatgccaagatttctcactctcatttcttgccatccgtgctatttcttttaccttcctatttcaaaacctggctaatgccactcatttatcaggtctcaccttagtactccatcctttcaaaggcatttctgattgccccttccctctgcccacagcttgaattaagagctcatccctgatttcatggtagtttggaaatatctttttagaaacctttatcatgcaaattgctcattttgattttctgactgtctcctcttctaaaagaaggcttacttgcagtattttttaatctttgtatttccatagagcatgacactcaataaatatatgagtgtgtgaaaaactgaataaatgtgtgtatgtctgtttcttttaatagagtaagttattttagggaagggccaatgactcttttctgcttgtaggctccacgtttcctagcatggtcctttgtatataatagttgatcaataagtagtgtctgaataatgatatacatgtctatcttccccagatcattctaagtttttcagcaaaaagattgtgtcataagaattagatagcctccagcacaacgaattacaaatacttcatactctaatgcacatgtttaatttttgcttggagttgaacttaagttatggtgccttatgagagagtcaggcagcttctctgtactacataagcatgtactcgatgaagcttggggtcaaaaacctggaaactaagtttagttggaaatttaaatgctggagactggatgcatcctaggagtggattactagtattgatactcctagacaattttctattcttatttggttctttctccataaacctgaccagtccatgtatagcaagcctcaaaggatgcaagccttgttctggtgttttttattgcaagtcaaagtctatcaggagctgaggaatgagcagcagtgggagggtgtattaatttcctgtggttgctgtaacaaattatcacaaatttggtagcttaaaaatagtaattttattttctcataattctggaggtcataagtcagtttcactgggctaaaataaaggtgttaacagggctgcatgtcctcttaaatgtcaaggagagaatctgttgcttgactcttcccatttctgatagctgcccatattccttggcttgtggcccttaatctctatctccatattcacatcatctctctgtctgtatgtgtgatcttcctttgccttcatcttataaggattcaagtgcttgcatttagggtccacctggagaatacaggatagtctcacctcaagatccctaacttaatcacatctgtaaagactcctttccaaataaaataatatttacagtttccatggattaggatatatctttggggaacattattcagcctactacagagatacctttctctttttgtagattcaaagtgcttgatcttctaagaacattgtttgcttacagacatatttcaggagtaaatgacttccaaactgatggtccgttgaaaaaaagcctggggctgctgtcaggaaaggtctaatttaggtcagcctaatgccactgaacagatgtatatggcaacattcccaactcccattaggaaaataagccattaattaatacttattgaggagctgataagtaactggaagagctggtctgagttctggacaaggaatcagtgacaatcagtttccactgtctggctgttgtgggtagattgtggtccatctctgtaggataaagtgtgcacagttggcttggcactcactcttctgtgtccagcagtagctcttgccatctgtcttatcaagagaataaaaatgggtctaagttgtcactgggagattactgagtatcagtggacactatgagctcgagtgggcaaccccatgcaaggttagagcagggacttcaccaatgtttgaattagggaacttcagtacctaaaattgggatgcagatgtttcttgacttcttcatgtcttttccacctctttcatataatctaagggggatatggaccttggaggagtcttcctcaaggctttggcaggtgctcctaaacatgcttcatccatgcctacttgagtgtaatctgctatcttaagccacaggcaggagagatcaatttttctagtaacttcttttataatccagctagctgaagaagtgtgatcaaagaatcttaaaagtgtgatcttgaagaatcttagtttctcttctgttgtagagagaggatagtaatagttgctaagcctataggctctgaagccagacttatctctatttccatgctggctccactacttaatagctgtgtgagcttaggtagataataaaatctcagattcccagttttctcaattgtaaaatgaggataatagtaaccaatatatgcaaggtgccaggagatattctaagcatgttacatgtatttaaccttcttattctcacatcaaccctatgaggtaaatgtactattgttatcctacttcaaagatgggaaaactgaggtacagagagattaagtaacctgtctagatcacacagtaacaagtcgcagaacaagaatttcaactcagagtatatgcttcaactcagaatatacttcaactcagcatatttgctgttaactatattttatgctgcttcttgtgcctcagattgtgaggatcaaatagggtggccatctattccaggtcaccttggaaagttctgggtaatatctcctgtccaggtgaattattaatagtgcctccttcttttattctcaaaggtattgtcacatcttggtttgaatatatttcacatttggattaaatagtctttacatgtgaaacactaagaacaatgaccaacccataggaagctctctgttaatattagctatcactgtttctactactgccatcaccaccactgtcaccatcacccacattcatcccaagtctgggacccttagggttaggggattaacccaagttctgcaaaggcatgtcatgggagccactgttcccagttcccacacccgtagcagacattgctcgttgatcacagtacaacagtcttccttacttagtgtcatagacaaccattcgtgatagatcacgtttgagatgtgaaattaaaattatttatcacacctagttttatttaatctcagaatacaaaatcccagcgtatggagaatctgaatttagtctgagcttgtggttttatatgaaaacttatttgattcctagaagtgataatgaatttgggacctctttagacatcctatgtcccttttctccaatatttctttctacctatttctctattatttctacctcttcttttatataaatataaaagaaatttaattcatcagtttcctattctctgcctataattttatatgttataataaaagactattgaaatactaccaaagtggacacaatataaataaggcaacggagtgagtcatcataggaattacagttggcacccaagatcaaaggcttagaaaatctatctttaaatgtgatttgtgtaactggtagtgaaattcatttcaggttgattttgcatggcataagggacatctagtggtgat

SEQ ID NO: 1902 - DNA, 7088 bp, Homo sapiens
tcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggct

SEQ ID NO: 1903 - DNA, 1025 bp, Homo sapiens
tcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagata

SEQ ID NO: 1904 - DNA, 8433 bp, Homo sapiens
aactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagta

SEQ ID NO: 1905 - DNA, 5079 bp, Homo sapiens
ttcagaagtgttttgatatagacatcgtctcaaaccaaatttaacgtcccttctagttggagaatttttagtggttcgatttagaaatattttcttaaaaatccacagatggggtcatactatgcacaagttacttctgaaaattggttagtttatagtccaaaagtaattaatatttgcatttaattcagtttggaattcagtaaattttagtaacattcctttgtgaagtcaagtcactggttataacaatgttttaaccatcagttgtttataatgcattgtttcatctatatataagtcatgggcattgaggaaggaaaatgtaccttcagtgaactttgaaatttagttcctcaaaggagggctattactagaagtgaacagaagtaaaacaaaataataactaagtatacagctcataaatgttcagatctagataattatgtttaatttctgcttttgcttaccatttaagatcaaacctctaggtatcttttaatctagctctttagattgttaaaatgttttatgtgaaatgcacatttagtttataagcagcaatttagtgtcctgtttccatgagacattgatattaaataaaacactagaaagaagtaatctaacttttttctcctttgtacaagcccctctttgcacctcatgtgatgttgcttactggatatcaaaaaagattagaagcagggtgatttcagatcaaagaagaagcatctgcctacccccagggtttttaaatatttaaatatttttctcgttaaaaaagtaactcaacagaactctaaataaaatacaattttaaggaaccaatgtatagtcattttaagctattgccagcaaaccaccagaagcgaggtgaaaggcaagctattatataatcacactttttccattgtattgaaagttaaattcagcttatttgccaaagaatgcttcaaatacactgaaattttacataatagtacaggctaaggcgggtggaacacaaggtcaggagatcgagaccatcctggctaacacggtgaaaccccatctctactaaaaatacaaaagaatgagccgggcatggtggcgggcgcttgtagtcccagctactcaggaggctgaggcaggagaatggggtgaacccgggaggcggagcttgcagtgagccgagatcgcaccactgcactgcagcctaggtgacagagtgggactccatctcaaaaaaaaaaaaaaaaaagtacagttatgaacctgtattattatatcacagttagactcaaatgactcttaatgacatttatttggactcatgtatattttaggctttttttttagcataattcattgactctaagatgtaatacttttcacattttatcagctttaaagtcaggatatgtattataatcaatggtttcttacaaatataattggcaaccatgttttgtttttcttagtggtatgtaaaacaatggtgtatcttaaaatcaatcatggcatcttagggtttgttttttttttttgccttttaagtaatgtttatttttcatttgcttgttttttctgttttttgatatttttaattttatgtctgtaggctattggggaacaggtggtgtttggttacatgagtaagttctttagtggtgatttgtgaaattttggtgcacccatcacctgagcagtatacactgcaccccatttgtagtcttttatccctcacccccttcccacccaccctgagtccccaaagtcaattgtgtcattcttatgcctttgcatcttcataagttagttcccacttatgagtgagaacatacaactatggaaaacagtgtggagattccttaaagaactaaaagtagatctactatttgatccagcaacccactactgggcatctacccagaggaaaagaagtcgttatacaaaaaagatacttgcacacagatgtttataacaacacaattcacaattccagaaatatggagccagcccaaatgcccatcaatcaacgagtggaaaagaaactgtaatatatatatatatgaatatatatgaatatatatagatgatggaatactactcagccatgaaaaggagtgagttaatggcattcgcagtgacctggttgagtttggagactattattctaagtgaagtaactcaggaatgaaatgaaacatcatatgttatttggtttttataacaggagatatagcttgtttatttcaagccacactcagtgttggaaaatgctgtttcttattctgtaggtccagcattcccaagctaaaagaaagttgtgtggcgctaaagtgtttggcaaggttgtattattgataggtgaattgctcataggaagagaaaaatttaagtgactatattaagaatgttctggtatttatagttctctgtcttttccattcttgagaatgtaatgttctttgtgttactctttaaagcaatggagaataaataaattgtttagtaagtcatgttgacattattccttaaaaaattgaaagagactgtatgtcccttcctcatagaatacacaaaactaaattacagctgaattaaagatttacatctaaaagcacttaaaagtaccagaagaaaatattttttaaagtgtgtattcgtatcactagagtgtggaagtcattccataatatgacactaatatcaaaatttataaagaaatgattgaaaggattgattacctcaaaatatataacaatagtctatcagaaaagatgaagcatagatttaaaaaaactggagaagaataattatgcagagataaacgtgtcagaaacaatagaatactttttttaatattttacatcaaaatgtatattctccagtccttaaacaggcattcaatgagcatctcttatgtctgaggtcataggctgggtacaagagaggtataaattaggctcaaatggggcccacaaagagccccaaatctagggttttattttcattgttagagtgtctatgtctatgtcagtaattgggattatttttaaactgaaaaactctatcccactttaaaactcctaaatagaacaagcatttatctaaccttaatatcatagcataactccttaaagtttattgactttaaaataactaaattcagtagctctcaaatatccatagtatgagtgacagacctgtaaaatctaattgactttatttggcagacacaggcaaacacatacatgtattttaacataatatgatgactacttagacataacctgatccttcaaatataactgaaaaaaaggtgctccattttgcatgatttattattgaactagagttccctttcctaggtacatggagcaaatagagaagataattagaattccacttttcttgaaatgtcaagaagggcaggtgtactctgacctcagctttaagtttaaccaaatatatagggggatttgagactgctccacatgtttctcatggaatttcccccaagcactactctctgaagagcctgaaaaagtatgtaagaaaagccttgttctctcttgacatgaagttatgctcagcctgcttattatgctagagcttagtgtctgaatagcagagaacgttttctcatccttagttatgtttgttgttctaacataacagtcttctgatcacgatgattctctataatcaacatttcttaagtgcccagtgaggtaagccttgcttctaaagaattttaaaatgtatttttagcaaggctctaaagattaagtcttcaccttgctgtcagcagttacatttttttctaaggggtaaaaagcacaaaccagaattatgctagatctccattaagatataaaacattttatggtgccgggttgctgttgacctacattgataattggaaatattacaacttattgcaaaggtactaagtattatctattataatatgtgttttgcatccctttctgtgatgtagataatattagtcctattttgcagatgaggaaaccaagactctgaaagctaaaaagcttgctaaagtcacgtggctaatgagtaataacaagattcaaaatcaaaacaacctgaccctgaaaccctcctgttaaccagtgaccttttctcctctcaaaattctgcagtaaatggaaaccatttcacatgtgtttattcattcacacctacagtgtgccagctcccagtgtagtctaggtatactatccatggtgaagaggacagcctaggtcgttgccctcatgggcttgcattccattgagacagatacatttctcagtgcttaatttagttaagtgagatgggggcgggaaagaagagaaaatagagagacagagaatcatggggttttgactttacgcgggagtcagggaaggcctccgtgaggatttgttagctgaaaggaaaccttggttgaagtgagggaggaggaaaccttgcagatatcttgggagaagagcacctgtacagaaagaacagcaagtgcacagccccctgtgctgggaataggcttgtgtctgagaaccacaaaaaaagccagtgtggctggaaagggcaggtaagggagagcataaggggaaatgggcacagagctagccacagccaactcagggaggcgttgtaggccctggtaaggatttaggactttcttttgacttctgtgataagaaaccagtgaagggttgggcttggggaagttgcccctggctgtgtggccgcagtggaaataagggaagcaggtaggatcctgccgtgacccgagagagatgtatggctgcgacagagccacaacagttgggaactggtgggtgatgacatttggggtctgttttgagaattcaggggatttatcatctcgttggtggcaggaacaaaactcatagcagcatagtgcaagaatacagacagcatcctgttaaggaccgcagtgttttctgcaacttcttccatgtgtctactgcaaattgtctgagaagggcagggcctaggaaacatggtggaagttttgagataaaaatattgcagcccatctgcatttccctgggagctcaatta

SEQ ID NO: 1906 - DNA, 1121 bp, Homo sapiens
actttgttatctttctggataacacgtttgatgggtgttaaaaggtaaagccaggaatggctttactttctaacagaatactttacaaagcagtttccagcttagatacttcctcctacagggaaccttcccaaggtgtttccttggcagtgctcccttccttatcccgccactgtcccacatgtcccacctaggccttgaagggcagaacctgtgctctgttcactgttgtattccagtgcctgacacaactatttgcacagtatttaggtgctgaacaaatatttattgaatgccaaaattggttcatttactaagcagaaagaaaggaaaatattttttgttggcagtgtctgcaaagagatttgtcttttcccatgaaaattgagaagtggggacagaaaagcaagaaagtgggagcaaaagtaattgagatccacagtggctcaggagtgttgaccggtgcagggtgtggtagaagcccgttaatgggtaggggagccagatacggaggctcagctgggctgggggcaggtctgcaagaaatgggggggtgtggagaaggttaccagccgttaccagagttttcctctgcattgggaatttctaaggtgtgtttttgtttttaaaacaatatctgtactttcaaaaatatggtttctttgctgcaaggggaacacatttattttgtgaaagtaagtgtacctagttaacagtttccatttattaatttctggaatagtgttttggttacttggaatgtgtgtgtgtattttctttctttctttctttttgagacagagtctcgctctgtcacccaggctggagtgcagtggcgccatctcggcttactgtagcctctgcctcccaggttcaagcgattctcccgcctcagcctcccaaagtactgggattacaggtgtgagccactgcgcccggcctattttctttctattacaagtcccttgcgggaaagatggtcgtagctcctattctaaatgaacagaagttctgtcttagaaattttcccattttacaagtgttcaaagaggaccaaatttcatcctctttccctgcctgtgtcctggaatcagctgagaagaaagacaggagtaaggtgg

SEQ ID NO: 1907 - DNA, 2632 bp, Homo sapiens
actttgttatctttctggataacacgtttgatgggtgttaaaaggtaaagccaggaatggctttactttctaacagaatactttacaaagcagtttccagcttagatacttcctcctacagggaaccttcccaaggtgtttccttggcagtgctcccttccttatcccgccactgtcccacatgtcccacctaggccttgaagggcagaacctgtgctctgttcactgttgtattccagtgcctgacacaactatttgcacagtatttaggtgctgaacaaatatttattgaatgccaaaattggttcatttactaagcagaaagaaaggaaaatattttttgttggcagtgtctgcaaagagatttgtcttttcccatgaaaattgagaagtggggacagaaaagcaagaaagtgggagcaaaagtaattgagatccacagtggctcaggagtgttgaccggtgcagggtgtggtagaagcccgttaatgggtaggggagccagatacggaggctcagctgggctgggggcaggtctgcaagaaatgggggggtgtggagaaggttaccagccgttaccagagttttcctctgcattgggaatttctaaggtgtgtttttgtttttaaaacaatatctgtactttcaaaaatatggtttctttgctgcaaggggaacacatttattttgtgaaagtaagtgtacctagttaacagtttccatttattaatttctggaatagtgttttggttacttggaatgtgtgtgtgtattttctttctttctttctttttgagacagagtctcgctctgtcacccaggctggagtgcagtggcgccatctcggcttactgtagcctctgcctcccaggttcaagcgattctcccgcctcagcctcccaaagtactgggattacaggtgtgagccactgcgcccggcctattttctttctattacaagtcccttgcgggaaagatggtcgtagctcctattctaaatgaacagaagttctgtcttagaaattttcccattttacaagtgttcaaagaggaccaaatttcatcctctttccctgcctgtgtcctggaatcagctgagaagaaagacaggagtaaggtggtcttcaattcagccagtcttcaattgttggagaccaaaatttacctttatgctgatcagggttagagctgctatgcagaacatggcttatctctgcgggcaagtggccttcctgaggctcatctccagagctgtgcagcagaatgttgccctcaaaagaggacagagggcaggactggctatgcatgcatgctcactcccttcttccagattcactgagcctgttttccttctgaattaagaggtaagaaagtaacacctggaaagatgtactttcccaaggtcacgcagatagctggcaacaggtttttctcctgggctctagaggcctttggtctgagtagaaagggcatggttatggggttggccaggccttgtgttcaccacattctgcttctgtgctcttagctttcatttctgcatctataccatggggttaaaatttctaccctcgggattcctgggagggttacctaaggtgtaactgttgaatgacctgaaccagtgctttgcactcagaatcagcaatgtaaatatcactcagccagcctggggcactttcctctatcaaaccttaccaatccttttcttcttcttcttctttttttttttttctcttcaattgaaacagggtctcactgtcttgcccaggctgaggtggaatgtggcacaatctccgttcactgtagcttccacttcacaggctcaatcaattctccagccttagcctccaagtagctataggcacgtgccatcacacctggctagtttttgtattttttgtagagatgggttttcaccatgttgcctaggctggtctcaaactcctgagctcaaagcgatctgcctgacttaggcttcgaaaatgctgggattacaggtgtgagccaccatgtccagcctcgttgttctttcttttaatcaccctggcttggcacctcagaaaacatggtgattggagtttagctttcagcagggtgggacttggatgttgactgttttaattttgatttttttttttttttttttgaaacggagtctcactctgtcgcccaggctggagtgcagtggcgcgatctcggctcactgcaagctctgccttccgggttcacgccattctcctgcctcagcgttgtgagtagctgggactacaggcgcctgccaccgcacccagctaattttttgtatttttagtagagatggggtttcaccgtggtctcgatctcctgacctcgtgatctgcccgcctcggcctcccaaagtgctgggattacaggtgtgagctaccgcacccagcccaattttgattttttaggaggaaaaaaaattgttcctaaggaagtcaagtcctaaattgaaagactttcatatattacacaaaccctagaaaaacttgggttacacctgggattgattttgaagtagggcgttgaactatgtgtcctgtttaacctcgaggagcaaatggctttccattctaaacattctcatttcttctctgggacattcttt

SEQ ID NO: 1908 - DNA, 20331 bp, Homo sapiens
tgtgccttcatctaaaattgtgatactatagttgatgttaaaattttaagagatacaggagaaattttgagctgagtgtcccagacagctggctagctattccagatgtgggacagaccactgtgtttctaggtggtttttagtttgcttggggtcaaagtcttaggattacatattatgtgtacaccatgcagaattctaagctctctacataaattatttaatgctctcagacagtttgcagataaaaaacctgaagccagagagcttaagtgttttgtataaacacactaagttacagatcaagggtttaaactcaggtctctttccaaaactatagctctttatcattattcagaactgaatttctttgattattataacatttatattccttctcaacttactgtattacagtatcattattcattaaacttcctttaaaaaatcagtgtgccctaattaatgaatttacaatatgaataatagcatttaaaaaaactacagcagctgggcgtggtggctcattcctgtaatcccagcactttgggagactgaggcaggtggatcacttttgagatcaggagttcaagaccatcctggccaacatagtgcaaccctgtctctactaaatatccagaaattagccaggtgtggtggcgggtgcctgtaatcccagctacttgggagtctgaggcaggagaatcacttgaactcaggaggtggaggctgtagtgagccaagatcgccccactgcactcaaacctgggcgatagagtgagactcagtctcaaaaacaaaaaacaaaccaacaaacaaaaacaaaaaacaaaccaaaaaagacatcagtcaaaaccccctacagtgacaaatagggttaattgaatggctgagttagggtcttattttatccttactagacaccatcattgtgtgttttataaatacctcgatgctttcaaaccattttaaaagacaaaaatattttaattatgattgtatttattgattaaaaaattaaaaatgggaaacatataacattattacgctattctaaatgctctttaatggtctcatagttttctactatgtactgtggtttatttaattcgttctctttaggttgttttcctctttttttctgcctgtgatgaatattcttagaggtcagtcatcttatgttttctttagtatattttttcagagttggagattatgggtcaaacagtatatatgcacattttaaactctccagaaatattacagtgttttaaactcctactagtagtacagattgagtttcctttatctgagatgcttgggaccagaggtgtttcagattttgaagtttttcagacttggggatatttgtattatatatatttactggttgagaattccaaatccaaaaatttgaaatttgaaatgctacaatgagcatttcctttgagtgtcatgtcagttctcaaaaagtttccgattttggagcattttggattttgcattttcagatttgggatgctcaacctgtatgtgagaaggtttacttcctcgtatccttactgacaacatctgccatttgctgatgaaaatttggatttcactgtcattttaatgtgcaattttaattgttaataggatatatttttaaaattttttattgactgtgtttcttcttttatgaaatgcctgttttaagtccttttcctaaatttttttattagaggtttatatgttcttactgaattttcagaagctctttttataagaatatgtaaacttttgtcttgaatatacaggggtattttccttcaagacaaaaattttctgtttcttacatgttcattatagaaaaatcaaacaataagctaaaaaaaggtataattcacctataaccctgctacctactgagaattatttttacattttgatttatactcctgctgtcttctttctgcacatatatacactgttaagggccccattagcctgtgttttcacataaggtcataatgacattaacatataaattataaagacttggtagcttttacctgttaattagcgggatgtccttttctacctttcccatcccggaagtatttctgagagcatggtctcaaataagtttgagaatgaatgtgtgtctgctggaagctcctattcttccgccattttccagtcctccagaagtttcctgatggtccatgtctgaattagacacccctcttctttgttccagttgcacctgtaattcttcagcatagtacttcttaaactgtttttaattgcctctcctccatgctaaactttcagctcttgtagagcacagaccctatctgctgtgttcatggtttttctttatgtctgatatctgtgtgtacatagcaggcattcagtaaatatgtgttgaattgacttttgttgaattttaatactcgattggagagttagacaccttcctatttgcacactttcccatcatacatccaagtatatgtataatgtcaatttcttttatctttttatgattttcctttatggtttgcctttgatgctattaattagtttctttttaataaccagaaagataactttttgtatcctttatttgtagtacaataaagtttgttttccatgttggtattcctgaaaaatctcattttagtattagagtatgctggaatagacaatataaatacctctaaactctcacttatagcagcctaaatctgcacgtgctgtaaggaaaacatttttaaataatttgccattaaacaatttctaatttaattgtcactttttttttttttttttttttgaggcaggatatcactctgtcacccaggctggagtgtagtggtatgattacggcttactgcagtcccgacgtcttgggctcaaggaatccttctacttcagcctcctgtgtagccaggaccacaggtgtatgccagcatgcctggctaattttttaattttattttttgtagagatggcatctcgctttgttgtccagggtagtctcagtctcctgggctcaaggagattcttccacttggcttcccaaagtgctgggattacaagcataaaccacaatgcctggcctcactttttataatggacttaaatcagtttggttgttttaaaagtaccctagcatttagcacatgaatacatctcattttgattagtggccaaagtatttttgggcattgtgagcattgtactactcccaggctgcttatggtatgttatagtatcagatacatctctttggatccatgctctaagtagaattgtgttgtataccttgcttaatccattaaatttttacctgtctgtttgagtatcaccaaaagaaagttgctatcacaatgtactttctactttttaatctactctactgattcattagtacacagccatggtgagacacttgagatgttctgctgaagacaattgttacatattgggattctggaaggacagcaagctagataaagataagtcatgcttttaagagtcccatggaacatcagtcattgtgatgtgaagaaagtgataaggtaatgcatgaagcagtttgagtcactatgatgtggatggtgggaagtagccctcttaatcaaagctttaagaacgaccaagaacctaaggaatagttacttataccaccagattatgcagataatgttaataacaacaaactcatttatatatatagatatatatatatatatatatttcaaaagaatgtagcagtcccataggttttatatatagaatcagcatagtatttgattataattaatgatatcatcttaaggacttcatctaatatacttattttgaaaataagatgcaaccatatatttttgacataaattatagttatttttcttcaattcaatgctttgatattttattctgtatccctatcagttaaatgtatatattatttaaagttaagagtatacaagttaaatatctcttattcgaaatgcttgggaccagaagtgtttcagattttggtgtgttttctctttattttggaatatttgcattatatttaccagttgagcatcccaaatccaaaaatcccaaatctgaaatgctccgatgagcatttcctttgaacatcatgttggtgctcaaaaagttttagattttagaacattttggattttggatttttagatttgagatgctcaacttgtatatacagtgcattctgtacttgcatttgaatactatatttggatttgtgggtgtttttattccaaagagctcaaattcccttagtatttaaagcacggtttcctaacatttttagagatagcattgtatggacacttttataataggacaacctttaagtaattttgaaataaaaggactagtttccttttacctcctagggcttgggttttataatcttaggattagaaagggctttaaggttatctgacccagtgcattacagatcttgtggtctatctacagtgccccattaaatggctcttcagcttcagggccttttatttatcaatttaacaaataccttttgaatgctgccctggggcaggcactgtgttaggtgctggacatattacagtatatcagacatggttcttctttttagtctagttggaaagatataagtaaatacataagttgtaaagcagcacagaagaggccataaaaaagcatgaaaaaagacagagccacttaatgtcacaaagtcatttcattttacacagttcaaagtcttagaaagtccttttttctcttgagccaaatactgcttctttaggtctaaataccgcccttctccagtgatcatctttcagttatttcaagatagttaagttatatttctgattggtattgtttgtatgttaatttcttttatcttgcttaaaattggcctaaattacaatttgttaaatatttttggatcttccttgtacaaaattttttctcttggggttcatatagtgcttctagggccaggtgtggtggctcacacctgtaaccccagcactttgggaggccaaggtgggcggatcacgaggtcaggagtttgagaccagcgtggccagcatggtgaaaccctgtctctaccgaaaatacaaaaattagccgggcatgctgctgtgcgcctgtaatcccagctactcggcaggctgaggtaggagaatcacaactctgggaggcggaggttgcagtgagctgaggtcacaacactgcaatccagcctgggcatcagagtgagactcactatatgtatatatatatagcttctgtggaataaatatgccaccccaaaatacactgctttggcatattttgagatggctattcagaaaagctacagaaagaggaatagctctgaaaagctgtccatttgtgggggagatttgcatccctggtagaaatccacactaggaaagtaaacagcagacagaaatggactttctttgagaatcccttatctgccttatttggatttaggaaaaaactaactcaggaaaagagactgaaggtctgacactgttaaaggtgtgacagagaaactttttcaacaggctaccatctattctttctgagggctgctacctgagagatttcatttgtaatacaaaatagcttttgttcagcttgcatttcctcccctcacccttccacaacctgtaagctatcttcccccactctggagctccaagcccctgactcttttctgtattttctgtatggtataaaaacttcagtcatttgtcccttcttagagtctcatattttgtgtggctcccctgcacatgtgcgtgtttataaatttatatacctttttttttgtttgtttgttttgagacactgtgtcactctgttgcccaggctggagtgcagtggcgcgatctcagctcactgcaacctctgcctcctgagttcaagtgattctcctgcctcaggctcccaagtagctgggattacaggtgtccacctccatgctggctaatttttatatttttagtagagacagggtttcaccatgttggccaggctggtcttgaacgccatacgtcaagtgatctgcctgcctcagcctcccaaagtgctgggattacagtcatgagccaccgtacccggtcttgaataccttttcttctgctaatctgtctattgtcagtttgttttatagacacaaattatcaaaccttcagaagggggaggaattaaaattttctttgctcttgtatgttactttttcccccatttgcgtattcttatatgtatctatctctgtctcccaaccctctgatggaattttaaaatatctctcaagtacaaacacctcaaataatccatcagatatgtggtttcctcagaagcttctcttctggattctttcattattctgctcaagtttgcattggtttcctctcttggcatactacctagctctcctctttatacttccactttttgttattctgggaatctcttcaccagtcttctgtattacttttcaattcctgattctttgtatgtgacttgtttttctcctcctttgcctttctctttggaggcctgtaggattttctttttgtccctggtgttctataatttcacagtgatgttgtggtgtggaaatctttctcattttttgagctgtgtctttgcttatcttttttccatttgggtaacaatctagatgttttgttgggagatcaaacaaatatcagtatctgcatgttttatctcttgggccaattggttttcttagagaagaacctcataatctgctcagggagttagtttaagaccagcatcattgtgggagcccagtggtggaagcaggaatgatgtcctcaccatttggtgtacaggttttcacataatgcctctgttttcagtaccactcttcagtcccacctttagctgtttgtagtatctgtctcattccacatcttcagaggttgaacctttagtcttctgcttgtgtagaaaagggtggctatcttgctggctgtgcagtggcatagagtatatatactttttccatgtcctcctgtttttaggagataatttcaggatatacttaaaatctaaaaccttttcacagttttaagggtaaagtttgaacttcaagctaagcctataaagttctttgtgatctagtccttcctttctctattggttcaacttggttcttccccttctggatgaactaagaccacaccacaacatactatgttggctacagcccgttgaacttggagggatacaaacgcatcacatttcacatgtgatgtacccctctacctggagtgccttcttttccttttcttccacaatttcttattcttaattgttgttttctctcagtagccccgctcactttcatctactgtctgatttaaatatcttttacctgtattcctttaccacctcaaacttatctttgatagtgttaccagaaagggatattgatccaaaccccaagagaggattcctggatttcacgcaagaaagaattcctggtgagtccacagattaaagtgaaagcaagtttattaagaatgtaaaggaggccaggtgtggtggctcatgcctgtaatcccagctctttggtattctgaggtgggtggatcacctgaggtcaggagttcaagaccagcctggccaacatggtgaaactccatttctactaaaaatacaaaattagcttggtgtggtggcccatgcctgtaatcccagctacttggcaggctgaagcaggagaatggcttgaacctgggaggtggaggttgcaatgagccgagatcatgccactgcactcctgtctgggcaacaagagcaaaactccgtctcaaaaaaaaaaaaaaaaaaaaaaaaaaggaatagaagaatgccactctgtaggcagagtaggagcatgggctgcttgactgaggatacttaacggttatttcttgattatagaaactgaacaaggggtaggctattcgtgagttttttgggaaaggggtgtgaatttcccagaactgaatgttcctactctttttagactatataggacaacctacaggcattgccatggcatttgtaaactgtcatggtgggagtgtcttttagcatgctaatgcattataattagtgtgcagtgagcggtgaggacgaccagagttgacttttgtcattatattggttttggtgggttttggttggcctctttactgcatcatgttttattagtgggggttctgtgacctgtatgttgtaccaacctcctatctcatctgtgactaagaatgcctgacctcctgagaatgcagcccagcaggagtcagcctcattttacccaacccctgttcaaggtggagttgctctggtttgaacacctctgacaataatatttatctatattatacagtagtttttgatgttatttctgtgccttttccaataagccttcagatttctgaagtgtacttgaccaagtatacttgttgagtaagtttgaaggtaacaaaaagagacaaaattgtgtcttaacatttcaaataatctgtaaatctgtgcctcaaaatatattacacttgaagcatcagagcaagaggatattacaaactgaaaaccgtccaaacattcctgcttctcctgtttccaccttttctcacagagtgtacctgtagactgttgacagaatactttgttgcagtcgatgaacttgtcaatttgagaatgagtattgtgcctttgtgtttcatatgtgctttaaaacattttggaatttttcagaacatgaacacattgtgttcttatactcaataaattttctaggtcatttaaaaataatgttaaattttaatcaataccagaagtttggctccatctgctacaaaagtacaaactcactgaacacatttaaaaataataacatttaaagcttccttgcccttgaggcattttcttctgaattggaatcaggctacctttgacattggcaacttagttggatatgtattgatcgacttaagaatgttgcttctgtgtctgttatcattatgagagaacatttattaactgtctgactacatactgccctgattctataaacgagaactatgtggatgtatttggtgctttttagggacttattttaagtgtatttatagagcacatctagcagcggacagaaaatattaaactagggtatgaatggacagtgaaatagtttacatcagcatcagagtatttggtttttctagcaaatgcaaataaggaactaaagctaaatacaatagactatacttttaattgaattaattttcatctaaatttaacagtgtcaagttatcatcccaggtgaacttcagaattcaaactagaaaaatagaatacatgtattcattatgggattgaatggcatgagccgaacttgggcctataaaaccagaactttagagttttaacctctctttagcataatccgtttatggccttgggcagattcttcacaaaaacagaaaacagacaatcaaaatgagaatgacaaaggtgtggagagatctagcttttaaagcatttggatctgagaagagcctcctaagtggttgtttcttctagctctttagcaattctgttttaaacccaatttctctgtcttttatattctgccttctgctatatttatatccattttccttacaaagacacaccattgtcctttggaagcaggttttataaagtaatagatgtattggcctagaatttgaaaaattatacaaagtaaaattctttttacatacatataaaagatatttctttgataggtttattgttcactaaatcgttaacttcacattttagtatgagacatcattgaggaatggcttatgttcattgacatttggctcatatgaatatgagagattttaaatttgtgtttgtagtttatttattggagaatgacctggattttgcatcactttagtgcaggacttgttttagttatttgtgtaaagatgtgtaatccaaggatctggccaagtgatttttagatgggaagtagagaagcattttgttttttaagactgttttttgagggcagttttagggtgacagcaaaattgagagagagacagagtttttccatgtgcccccttgaccccacccttgcatagcctcccctattgtcaacaacccccaccagagtggtacatttattacaattgatgacctttcattgacgcatcataatgacttacagttcatagtttatattaagatcattcttggtgttgtacattctgtgggtttggacaaatgtataatgaccatgtatccagcattataatatcatacagagtattttcactaccctaaaaatctctgtgctctgcctgttcattccctgccaacatgtggtaaccactgatcttttttttttctatctccacagttttgccttttccagaatgtcatatagttggaatcagtatggaatcagtatgtagccttttcagattggctttcttcacttagtaatatgcatttaaggtttcttcatgcttttcatggcttgacagctcatttatttttaatgctcaatggtattctgttatctggatgaccccagtttacccattcacctattgaaggatgttttggttgcttccaagttttggcaattatgaatgaagtttctataaacatccatgtgcaggggtttttgtggacatgcattttcagctcctttgagtagacaccaaggaatgtaattgctggttcatttatggtgagagtatgtttagttttgtaagaaactgccaaactgtcttccaaagtggatgtgttattttgcatttccagtagcaatgaatgaaagtttctgttgctttatatctttgccagcatttggaggtgtcagtgttcgggattttggcaattctagtaggtatgtagtgatatcttgtttcaatttgcactttcctgatgacatgcaatgttgagtatctttttatatgcttatttgccatctgtatatcttgtttggtgaggtgtctgttagtctttggcccattttttaatcaggtttttaaaattattaagagttctttgtatgttttggctaatggtccattatcagatgtatcatttataaatattttctctctggcagtggcttgttttctcattctcttgacattgtttttcatggagcataagtttttaattttaacaaagtctatcttatcaattgtttctttcatacgagtgggttctgcctttgatattatctcagaaaagtcatcaccatattcagagttatctaggttttctcctgtgttatcttccaggattttaataattttatattttacatttaggtctatgatccattttgttaatttttgttaagggtgtaaggtctgttctagattcacatttttgcatgtggctgtctagcaccatttttgaaagggctctttgctccattgtattccctttgctcttctgtcaaaagcgagttgagtatatttatgtgggtctccttctgggctctctgttctgttgcattgattggtttgtctattctttagccaataccacactgtcttgattactgtggctttataggaagccttggagtcaggtagtatcagtcctccagctttgttcttcagtattgtgttagctattctgggtcttttgcatttctacataaagtttagaatcagttcgttgataaccactagacaatcatttaaaatttttctttatctttaatgatcctaatattagtctgtcaaagaaaaacattgccaatcatatttcactggcccttggaggaatgaaacaatgtaggaatgacgcttttgaattttgagtaaattttatttgtaaatctgttttagtactatcaaaatatgcttattttctttttctaatattattcataatctactcatatcttggaagataaacttaactctggtagcatttgctctgttttcagctattatcacaatgacaaactatgatttttaaaaaaccatcatactggggcagttccaagatggccgaataggaacagctccagtctacagctcccagcatgagcgacgcggaagacgaatgatttctgcatttccaactgaggtactgggttcatctcactggggattgtcggacagtgggtgcaggacagtgggtgcagcgcaccgagcatgagccgaagcagggcgaggcatcgcctcacctgggaagcgcaaggggtcagggaattccctttcatagccaaggaaagagatgacagatggcacctggaaaattgggtcattcccaccctaatactgcgcttttccaacggtcttagcaaacggcacaccagaagattatatcccgcgcctggcttgaagggtcctacgtacacggagcttcgctcattgctagcacagcagtctgagatcaaactgcaaggcggcagcgaggctggggaaggggtgcccgcccttgctgaggcttgagtaggtaaacaaagcagctgggaagctcgaaatgggtggagcccagcgcagctcaaggaggcctgcctgcctctgtagactccacctctcggggcagggcatagccgaacaaaaggcagcagaaacctctgcagacttaaatgtccctgtctgacagctttgaagagagtagtggttctcccagcatggaccttgagatctgagaatggacagactgcctcctcaagtgggtccctgacccccgagtagcctaactgggaggcaccccccagtaggggcagactgacacctcacatggccgggtactcctctgagacaaaacttccagaagaacaatcaggcagcaacattggctgtttagcaatattcgctgttctgcagcctccactgccgatacccaggcaaacagggtctggagtggacctccggcaaactccaaacggacctgcagctgagggtcctgactgttagaatgaaaactaacaaacagaaaggacgtcgacaccaaaaccccatctgtacatcaccatcatcacagaccaaaggtagataaaaccacaaagatggggaaaaaacagaacataaaaaactgaaaattctaaaaatcagagcgcctgtcctcctccaaaggaacacagctcctcaccagcaacggaacaaagctggacagagaatgactttgacaagttgagagaagaaggcttcagactatcaaactactctgagctaaaagaggaagtttgaacccatggcgaagacgttaaaaaccctgaaaaaagattagacgaatggctaactggaataaccaatgcagagaagtgtttaaaggacctgatggagctgaaaaccatggcacgagaacttcatgacgaatgcacaagcttcagtagccgatgcgatcaactggaagaaagggtatcagtgatggaagatcaaatgaatgaaatgaagtgagaagagaagtttagagaaaaaagaataaaaagaaacgaacaaagcctccaagaaatgtgggactatgggaaaagaccaaatgtacgtctgattggtgtacctgaaagtgacggggagaatggaaccaagttggaaaacactctgcagaatattatccaggagaacttccccaatctagcaaggcaggccaacattcaaattcagaaaatacagagaatgccacaaagatactcctcgagaagagcaactccaagacacataattgtcagattcaccaaacttgacatggaggaaaaaatgttaagggcagccagagagaaaggtcgggttacccatgaagggaagcccaccagactagcagctgatctctcggcagaaattctacaagccagaatagagtggaggccaatattcaacattcttaaagaaaagaatttttaacccagaatttcatatccagccaaactaagcttcataagtgaaggagaaataaaatactttaaagacaagcaaatgctgagagattttgtcaccaccaggcctgccctaaaagagctcctgaaggaagcactaaacatggaaaggaacaaccagtaccagccactgcaaaaacatgccaaattgtgaagaccattgaggctaggaagaaactgcatcaactaacgagcaaaataaccagctaacatcataatgacaggatcaaattcacacatgacaatattaaccttaaatgtaaatgggctaaatgctcaattaaaagatacagactggcaaattggataaagagtcaagacccatcagtgtgctgtattcaggaaacccatctcacatgcagagacacacataggctcaaaataaagggaaggaggaagatctaccaagcaaatggaaaacaaaaaaaggcaggtgttgcaatcctagtctctgataaaacagacttttaaccaacaaagatcaaaagagacaaggccattacataatggtaaagggatcaattcaacaagagctaactatcttaaatatatatgcacccaatacaggagcacccagattcataaagcaagtccttcgagacctacaaagagacttagactcccacacaataataatgggagactttaacaccgcactgtcaacattagacagatcaacaagacagaaagttaacaaggatacccaggaattgaactcagctctgcaccaagtggacctaatagacatctacagaactctccaccccaaatcaacagaatatacatttttttcagcaccacaccacacctattacaaaattgaccacatacttggaagtaaagctctcctcagcaaatgtaaaagaacagaaattataacaaactgtctctcagaccacagtgcaatcaagctagaactcaggattaagaaactcactcaaaaccactcaactacatggaaactgaacaacctgctcctgaatgactactgggtacataacgaaatgaaggcagaaataaagatgttctttcaaaccaacgagaacaaagacataacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagagctgaaggagatagagacacaaaaaacccttcaaaacatcaatgaatccaggagctggctttttgaaaagatcaacaaaattgatagacagctagcaagactaatacagaagaaaagagagaagaatcaaatagacacaataaaaaatgataaaggggatatcactaccgatcccacagaaatacaaactaccatcagagaatactataaacacctctactcaaataaactagaaaatctagaagaaatggataaattccttgacacatacaccctcccaagactaaaccaggaagaagttgaaactctgaatagaccaataacaggctctgaaattgaggccataattaatagcttaccaaccaaaaaaagtccaggaccagatggattcacagccgaattctaccagaggtacaaagatgagctggtactattccttctgaaactattccaatcaatagaaaaagagggaatcctccctaactcattttatgaggccagcgtcatcctgataccaaagcctgacagagacacaacaacaaaagagaattttagaccaataaccctgatgaacatcgatgcaaaaatcctcaataaaatactggcaaactgaatccagcagcacatcagaaagcttatccaccatgatcaagtgggcttcatccctgggatgcaaggctggttcaacatatgcaaatcaataaacataatccagcatataaacagaaccaatgacaaaaaccacatgattacctcaatagatgcagaaaaggcctttgacaaaattcaacaacccttcatgctaaaaactctcaataaattaggtattgatgggatgtatctcaaaataataagagctgtctatgacaaacccacagccaatatcatactgaatgggcaaaacctggaagcattccctttgaaaactggcacaagacagggataccctctctcaccactcctattgaacgtattgttgaatagttctggccaaggcaatcaggcaggagaaggcaataaagggtattcaattaggaaaagaggaagtcaaattgtccctgtttgcagatgacatgattatatatctagaaaaccccattgtctcagcccaaaatctccttaaactgataagcaacttcagcaaagtctcaggatacaaaatcaatgtgcaaaaatcacaagcattcttatacaccaataacagacggagagccaaatcatgagtgaactcccattcacaattgcttcaaagagattaaaatacctaggaatccaacttacaagggacgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcctcatcaagctaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctacaataaccaaaacagcatggtactggtaccaaaacagagatatagaccaatggaacagaacagagccctcagaaataacgccgcatatctacaactatctgatctttgacaaacctgagaaaaacaagcaacggggaaaggattccctatttaataaatggtgctgggaaaactggctagccatatgtagaaagctgaaactggatcccttccttacaccttataaaaaaattaaatttggattgaagacttaaatgttagacctaaaactgtaaaagccctagaagaaaacctaggcaataccattcaggacatagacataggacttcatgtctaaaacaccaaaagcaatggcaacaaaagccagaattgacaaatggtatctaattaaactaaagagcttctgcacagcaaaagaaactaccatcagagtgaacagccaacctacagaatgggagaaaatttctgcaatctacttatctgacaaagggctaatatccagaatctacaatgaactccaacaaatttacaagaaaaatgtaaccccatcaacaagtgggtgaaggatatgaacagacacttttcaaaagaagacatttatgcagccaacagacacatgaaaaaatgctcatcatcactggccatcagagaaatgcaaatcaaaaccacagtgagataccatctcacaccagttacaatggcgatcattaaaaagtcaggaaacaacaggtgctggaaaggatatggagaaataggaagacttgtacactgttggtgggactataaactggttcaaccattgtggaagtcagtgtggcgattcctcagggatctagaactagaaataccatttgatccagccattccattaccgggtatatacccaaaggattataacacatgctgctataaagacacatgcacacgtatgtttattgcagcactactcacaatagcaaagacttagaaccaacccaaatgtccaacaacaatagactggattaagaaaatgtggcacatatacaccatggagtactatgcagccatataaaaggatgagttcatgtcctttgtagggacatggatgaagctggaaaccatcattctcagcaaactattgcaacgacaaaaaccaaacactacatgttctcattcataggtcgaattgaacaatgagaacacatggacacaggaaggggaacatcacacaccggggcctgttgtggggtggggggaggggggaggtatagcattaggagatatacctaatgttaaatgacgagttaatggatgcagcaccccaacatggcacatgtatacatatgtaacaaacctgcacgttgtgcacatgtaccctaaaactttaagtataataatttaaaaaaacccatcatatttacccaaagtactaaatatttataggtatgaattgaattcagatgggatatatacacacacaatacagtattgtattgtagaaatattgatatttacattcaacaggttatgtttgtattaatcaggtttaaatgtagggtaagataaatgtcctttattacaacaatttttatggtacattaatgtttaataatgccctatctttaaattagtttataactaattctctgtggaagcattgtagaatctaaaaatctgaattaagatcagaattaacacaaaaaaattgcatctgttgccattttatgtttttgaaatggagtctcgctctgtcacccagggtggagtgcagtggtgtgatctcacctcagtgcaacctctgcctcccaagtttaagtgattcttgtgcctcagcctcccaagtaactggggttacaggcatgtgccacctcacccagctgatttttgtatttttatagaaagagggtttcaccatgttggtcaggctggtctcgaactcctggcctcagcaatctgcccgcctcagtctcccaaagtgctgggattgcagatgtgagtcactgtgcccagccttctgttgccattttaaaactaagagttaaaagatgcttttgtataattttctagaaaatatcttttatacttattttcttctaactacatttaaaatacattttaaaaagcagaaagcaaaaatgaagtctaagcaaatttcccgtgaatacatttcttttacaataaatgtatgccagttattcagtgttagaattgaatatagttagattcttgagattctgtttttaaaagacaccacagtattttgtttttatatgaagtattatggtaaatgtgatcattaccttaaatatatggcatcaggtttttaaagtggtattttgtggattttgttaaatctgtctcaaagtctattttctcatgttatgtttgaagtatgggtatgatagtacccagaaaaacaggcctttcaaaacaaaatactctacttttatgactccataaaaaatacaatctttattattatccatagactgaataaaacatcttacattttatgtttcattttattcaccataatgcctattttcaataaaattacaggtgattttaaatatgactagacttttttttttaatagaaagatcacataatggcttaagtatattccattaggagtagtatttctcttgtctttttgttcagccattggagtcccctgtgaccttgggtactttttccataggcgaactgatgcttcatgacgttctgtgttttctggtagcttgcctgttgcctgcctctgggttcgtcatcccccttatgctgacttaggcaatatttcttcagtctcttatcttggggctttgatgcatatgttctgaaggtggccacagtgactttgggtagcagcagatggtaaaccttcaggctgccaccagctaaactggtgttaagttggaaagttaacgtttgatgaagaatcagtagtgcatatgaaagaactttcactgctgaaatatcttttaattaaaaattagcatactaaaacctttgtgaatgtctgggcatttaaagaaatctacaattagttgtgttcttatagaagtatttatttaccagtttagtcttatgttacttgctcttcctaacctggttctttttcctctgtttctaccccagtttgttggtagttaagataaatcagataactacataaattgaaatataggttgtttttaggaatcttgggtgtttgcataaacaaagtatattttgaattatggcattttggattttaataactaagaagagatgtggattttaagtacaatcttcatataattctggtagatttggtctgttttcttctacctttgaaggtatttctggatcaaataggagcctgaagaactcaacctgcctcaaagagatatttccttttgttctaaattagttggtgattcttgactctgccgttcttaactttgttaactttgcagaaattgatgcagcgacttctgatgagctaaagctgtaggcacaacatattttgcttttggagttactgagcagtgggtaca

SEQ ID NO: 1909 - DNA, 6292 bp, Homo sapiens
tcaaaatatgcttattttctttttctaatattattcataatctactcatatcttggaagataaacttaactctggtagcatttgctctgttttcagctattatcacaatgacaaactatgatttttaaaaaaccatcatactggggcagttccaagatggccgaataggaacagctccagtctacagctcccagcatgagcgacgcggaagacgaatgatttctgcatttccaactgaggtactgggttcatctcactggggattgtcggacagtgggtgcaggacagtgggtgcagcgcaccgagcatgagccgaagcagggcgaggcatcgcctcacctgggaagcgcaaggggtcagggaattccctttcatagccaaggaaagagatgacagatggcacctggaaaattgggtcattcccaccctaatactgcgcttttccaacggtcttagcaaacggcacaccagaagattatatcccgcgcctggcttgaagggtcctacgtacacggagcttcgctcattgctagcacagcagtctgagatcaaactgcaaggcggcagcgaggctggggaaggggtgcccgcccttgctgaggcttgagtaggtaaacaaagcagctgggaagctcgaaatgggtggagcccagcgcagctcaaggaggcctgcctgcctctgtagactccacctctcggggcagggcatagccgaacaaaaggcagcagaaacctctgcagacttaaatgtccctgtctgacagctttgaagagagtagtggttctcccagcatggaccttgagatctgagaatggacagactgcctcctcaagtgggtccctgacccccgagtagcctaactgggaggcaccccccagtaggggcagactgacacctcacatggccgggtactcctctgagacaaaacttccagaagaacaatcaggcagcaacattggctgtttagcaatattcgctgttctgcagcctccactgccgatacccaggcaaacagggtctggagtggacctccggcaaactccaaacggacctgcagctgagggtcctgactgttagaatgaaaactaacaaacagaaaggacgtcgacaccaaaaccccatctgtacatcaccatcatcacagaccaaaggtagataaaaccacaaagatggggaaaaaacagaacataaaaaactgaaaattctaaaaatcagagcgcctgtcctcctccaaaggaacacagctcctcaccagcaacggaacaaagctggacagagaatgactttgacaagttgagagaagaaggcttcagactatcaaactactctgagctaaaagaggaagtttgaacccatggcgaagacgttaaaaaccctgaaaaaagattagacgaatggctaactggaataaccaatgcagagaagtgtttaaaggacctgatggagctgaaaaccatggcacgagaacttcatgacgaatgcacaagcttcagtagccgatgcgatcaactggaagaaagggtatcagtgatggaagatcaaatgaatgaaatgaagtgagaagagaagtttagagaaaaaagaataaaaagaaacgaacaaagcctccaagaaatgtgggactatgggaaaagaccaaatgtacgtctgattggtgtacctgaaagtgacggggagaatggaaccaagttggaaaacactctgcagaatattatccaggagaacttccccaatctagcaaggcaggccaacattcaaattcagaaaatacagagaatgccacaaagatactcctcgagaagagcaactccaagacacataattgtcagattcaccaaacttgacatggaggaaaaaatgttaagggcagccagagagaaaggtcgggttacccatgaagggaagcccaccagactagcagctgatctctcggcagaaattctacaagccagaatagagtggaggccaatattcaacattcttaaagaaaagaatttttaacccagaatttcatatccagccaaactaagcttcataagtgaaggagaaataaaatactttaaagacaagcaaatgctgagagattttgtcaccaccaggcctgccctaaaagagctcctgaaggaagcactaaacatggaaaggaacaaccagtaccagccactgcaaaaacatgccaaattgtgaagaccattgaggctaggaagaaactgcatcaactaacgagcaaaataaccagctaacatcataatgacaggatcaaattcacacatgacaatattaaccttaaatgtaaatgggctaaatgctcaattaaaagatacagactggcaaattggataaagagtcaagacccatcagtgtgctgtattcaggaaacccatctcacatgcagagacacacataggctcaaaataaagggaaggaggaagatctaccaagcaaatggaaaacaaaaaaaggcaggtgttgcaatcctagtctctgataaaacagacttttaaccaacaaagatcaaaagagacaaggccattacataatggtaaagggatcaattcaacaagagctaactatcttaaatatatatgcacccaatacaggagcacccagattcataaagcaagtccttcgagacctacaaagagacttagactcccacacaataataatgggagactttaacaccgcactgtcaacattagacagatcaacaagacagaaagttaacaaggatacccaggaattgaactcagctctgcaccaagtggacctaatagacatctacagaactctccaccccaaatcaacagaatatacatttttttcagcaccacaccacacctattacaaaattgaccacatacttggaagtaaagctctcctcagcaaatgtaaaagaacagaaattataacaaactgtctctcagaccacagtgcaatcaagctagaactcaggattaagaaactcactcaaaaccactcaactacatggaaactgaacaacctgctcctgaatgactactgggtacataacgaaatgaaggcagaaataaagatgttctttcaaaccaacgagaacaaagacataacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagagctgaaggagatagagacacaaaaaacccttcaaaacatcaatgaatccaggagctggctttttgaaaagatcaacaaaattgatagacagctagcaagactaatacagaagaaaagagagaagaatcaaatagacacaataaaaaatgataaaggggatatcactaccgatcccacagaaatacaaactaccatcagagaatactataaacacctctactcaaataaactagaaaatctagaagaaatggataaattccttgacacatacaccctcccaagactaaaccaggaagaagttgaaactctgaatagaccaataacaggctctgaaattgaggccataattaatagcttaccaaccaaaaaaagtccaggaccagatggattcacagccgaattctaccagaggtacaaagatgagctggtactattccttctgaaactattccaatcaatagaaaaagagggaatcctccctaactcattttatgaggccagcgtcatcctgataccaaagcctgacagagacacaacaacaaaagagaattttagaccaataaccctgatgaacatcgatgcaaaaatcctcaataaaatactggcaaactgaatccagcagcacatcagaaagcttatccaccatgatcaagtgggcttcatccctgggatgcaaggctggttcaacatatgcaaatcaataaacataatccagcatataaacagaaccaatgacaaaaaccacatgattacctcaatagatgcagaaaaggcctttgacaaaattcaacaacccttcatgctaaaaactctcaataaattaggtattgatgggatgtatctcaaaataataagagctgtctatgacaaacccacagccaatatcatactgaatgggcaaaacctggaagcattccctttgaaaactggcacaagacagggataccctctctcaccactcctattgaacgtattgttgaatagttctggccaaggcaatcaggcaggagaaggcaataaagggtattcaattaggaaaagaggaagtcaaattgtccctgtttgcagatgacatgattatatatctagaaaaccccattgtctcagcccaaaatctccttaaactgataagcaacttcagcaaagtctcaggatacaaaatcaatgtgcaaaaatcacaagcattcttatacaccaataacagacggagagccaaatcatgagtgaactcccattcacaattgcttcaaagagattaaaatacctaggaatccaacttacaagggacgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcctcatcaagctaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctacaataaccaaaacagcatggtactggtaccaaaacagagatatagaccaatggaacagaacagagccctcagaaataacgccgcatatctacaactatctgatctttgacaaacctgagaaaaacaagcaacggggaaaggattccctatttaataaatggtgctgggaaaactggctagccatatgtagaaagctgaaactggatcccttccttacaccttataaaaaaattaaatttggattgaagacttaaatgttagacctaaaactgtaaaagccctagaagaaaacctaggcaataccattcaggacatagacataggacttcatgtctaaaacaccaaaagcaatggcaacaaaagccagaattgacaaatggtatctaattaaactaaagagcttctgcacagcaaaagaaactaccatcagagtgaacagccaacctacagaatgggagaaaatttctgcaatctacttatctgacaaagggctaatatccagaatctacaatgaactccaacaaatttacaagaaaaatgtaaccccatcaacaagtgggtgaaggatatgaacagacacttttcaaaagaagacatttatgcagccaacagacacatgaaaaaatgctcatcatcactggccatcagagaaatgcaaatcaaaaccacagtgagataccatctcacaccagttacaatggcgatcattaaaaagtcaggaaacaacaggtgctggaaaggatatggagaaataggaagacttgtacactgttggtgggactataaactggttcaaccattgtggaagtcagtgtggcgattcctcagggatctagaactagaaataccatttgatccagccattccattaccgggtatatacccaaaggattataacacatgctgctataaagacacatgcacacgtatgtttattgcagcactactcacaatagcaaagacttagaaccaacccaaatgtccaacaacaatagactggattaagaaaatgtggcacatatacaccatggagtactatgcagccatataaaaggatgagttcatgtcctttgtagggacatggatgaagctggaaaccatcattctcagcaaactattgcaacgacaaaaaccaaacactacatgttctcattcataggtcgaattgaacaatgagaacacatggacacaggaaggggaacatcacacaccggggcctgttgtggggtggggggaggggggaggtatagcattaggagatatacctaatgttaaatgacgagttaatggatgcagcaccccaacatggcacatgtatacatatgtaacaaacctgcacgttgtgcacatgtaccctaaaactttaagtataataatttaaaaaaacccatcatatttacccaaagta

SEQ ID NO: 1910 - DNA, 4838 bp, Homo sapiens
ttctggattgctagtgcaaggttagggcttgagatgaaactaatgaattgtcatctaaatgcccttccacgccagtttgggactatgggctttatccttttagtacctgctagcagaaattgttttttggttttttttggcaaggggagagggacaccaaagagttttagattaggcaacaacatgatgattaaattttcaacttaggaagagagctctcatcaatatggaagagcttggagaagataagaacagaggcaggaaggctgggtaggagattgtggcatgaactccagtgagagatcaggaaggctgctcatcaggagatgaatgccacagacatcaaagagctaacaactgatgagttgaatgcagggggctgagtaggactctgaggctttttgcttggtcgcacgtggtggaccggtggtccattgaaccctctgctgtctcctcatcccaccactgccctctcctctctcctcttccctccttagctaagctcatcatctcagtaacacttctgccatagcccataacttctttgcctcttgtcctcacaccaatctagcaaaactccagccctgaatgaacacatcttttctcttctttgtgcttacacctgagccctgcacctggaaaaagtcacatttcagtgcagattggccagttcacatcatgctaatttcctagagctgctgtaacaaattgccacacatttggtggcttaaaacaacagaaatttaattatcttacaattctggggtccagaaattcaaaattcatctcactgggccaaaattaaggtgtcaacaggaccacactccctctgggggctctagggcagtggtcccaaacctttttggcaccagggactagtttcctggagaacagtttttccatgggctgcagtagggggaatggtttcaggataaaactgttctacctcagatcatcaggcattagattctcataaggagtacacaacctagatcccttgcatgtgcagttcaccatagggtttgcacttttatgagaattgaatgccgccacttacttgacaggaggtgtattagggttttctagagggacagaactgataggagatatatatgtgaatttattaagaattaactcacacaatcacagggtcccacaatcagctgtctgcaagctgaggagcaaggagagccagtccaagtcccaaaactgaagaacttggagtctgatgttcaaggataggaagaatccagcatgggagaaagatgtagtctgggaggctaggccagtctctccttttcacattttctgcctgctttatattcattgacagctaattagatggtgcccacacagctgattagatggtgcccacccagattaagggtgggtctgccttccccagtccactgactcaaatgttaatctcctttcgcaacaccctcacagacacacccagggtcaatactttgcatccttcaatccaatcaagttgacactcagtattaaccatcacaggaggtgaagctcaggcggtaatgctggctcaccccgatctcctgctgtgtggcccagctcctaacaggccacagactgggggctggggactcctgctctagggacgatttgttccttgcctcttgcggcttctggtgactgtcagcaggcttgtgtgtggctgcatcactctactctctgcctccatcctcacgtggccttctccttgtctctgtctcaaagctccctctgccactctcttttaaggatacatatgattgcatttaaggcttccagatagtctagaataaacatctcctctcaagatccttaaataaatcatatcttttgccatataaggtactattcacactttctggggattagaagtgaacatgcagtagtccctttgtatctgcaggttctgcatccactgattcagccaaaaatattggaaaaataaaaattaaaaattaatacagattttaaaaatacagtataacaactatttacaaagtattacatcacattagatattataagtaatctggagatgctttaaagtatacagaaggagtatatgggaggagtagctgtggattttgatattcacaggatgatgctggaaccaacccccgacaaataccaaggaatgattgtatttcgcggggacatttttcttcctaccatttacacttatgcaggaccactgaccttggagggcccttgacctgcctggcaatctgaccaaattactctggaaggcttgtcctcccactttccctaatgctgattcctttcattcctgacccacctatgggtcacatcacttttcccacatcattctcaacaagtgaccttgttgtgttctctatggggggaaaagaaaagaaagaaaaagaaatccctggacctggaccagaatttcttaacttgttgctaaagttaataaacctacctgcatctttcctcacttcttctcctactaaaataatggatctctccatccctgtcctgagaccatctctactcaggctctggataccactctctcctgcttcctcaggaaccttaaatggccaatcaccccacctttgttttgtagagtcagccttttcttcttgataaggtccttcccttcagctcaagttttaaaactcttccttcaggaattttccttcttaaaagaacaatttaaaaaccttacaacaaacaaaattccaccccctggccaatccatcactaagtcctgctgatggtaccttgtaagtctttctaattcaccaacttctccccttctcagcctgctatgagtccagtctgtcatcacatactcctggacgaccatagtaacctttctgcatccatttttggcacctcacaattgctctgttaagctgccttcagttgtgtgtgattggtatgtgagctccatgaggtcagggacttagttccattcatgtgttccctgtgtcctcatcatcttgaaaagggccagaaacacagtagctgttcaataaatgtttgttgaaggtattcacataatttatcactaatttcaggaggaagacaaagttccttaacagcccaaaaggcccagaaaggcctgacccctactcatctctccacctcatcttgtgtcatcttcccttgttccctgagctctagacacattggtcttctatgaacgctcccagttttctcctgccccagggtatgtgtagagaaatgtttcctcattgtttagaacattcccctctgccccaacccaacttttcctaataaataccactcagccttcagatctcagctcatatatagcaagttgcttccttggaaaatctttccttagcaccattatatgctctgttatgttctcgttgcacatatatctgtcatagaaatttcccagtaagaactgtgttcatatttggtgactatttgattcatgtctgtcttagtccattcagactgctataacaaaatatcttagactcagtgatttacaaacaacagaatttattgcttacaattctggaggctgagcagtccaagatcaaggcaccagcagatttgttgtctggtaagggcctgttccccatacatggcaccttcttgctgcatcttcatgtggaggaagggtaagagagctcactcaggtctcttttataaggacactaattccatttatgagggtggagccctcatcacttaatcacttcccaaaggttccaccacttaatactatcacattggctattagattcaacataagaacttgatggagggggctgtcaacattcagactgtatcaatgtctgtctttcccatcaaatgaggacaggggccactatattcccagtgcttagcatactgtctgacacacagagatgctcaataggtatgcactgcaggaacaaatgaagggataatggaataatggcaaggctgagatcagttgcaggaggagaaggtttagtggaagggtcacaactcagttttgcccatgttggagggccccacagctaattcagctggagaggtacactcttgtttgggaatctgggctgggagctaaggacagagggcaggctggatatctagacttaggtggttggcaaccctgtagtagatgcaaaagatgggccatataagaggattcatgtctagagatgagagggggatgggattaagggcagactgggagctcagaaaggaagacccacagattaaaaaaagatgagctaagtgtagagatgtaaaggagggacgaggttgaggggcacgtgaagcagcaggtgaggccaagtgaaggtgaaggacagactgggggtaaaatgagggattggggagaatcaggaaggtttagattttctgagaggaaaaaaatctcctgctggcctaggccaagcaggtgacctgcatgagtggagtgtgtttacctgtgtgcatgcttatacgtgtgtcatagggaacaccacaccactctcaatgtgacttcacttctcaatagattgcctggcatctttttacagcaacccaaactctctgaggcaagtaaggcaggtgtaatgatctttcttttctaggtgcaatattaagttggactcatatcctaggccaatgctctttccaccaaaccacactatttcactgggctctagccagcttgtccggagcttgaagacatattactgtcttatttcagcatttctgtctactgcagatgaaattggcctccagccagagaaaaataaaatgcccttgataaacggcaatatagtaggatcatagctttaggaaattgtgatgctccttgtaacattccccgctttttttct

SEQ ID NO: 1911 - DNA, 4615 bp, Homo sapiens
aatttaatgtttatgcttactttcatagtgttttcttttttgtagaaaatgcgtaattgatatagatccagtcacctactaatgcagtgtttattagcttaaggagcttttgggctgagattatggggttttctatgtgtagactcatattatcttcaaagagagataatttgacttcctttcttcctattaatatttacaggccttttatttctttctcttgcatgattgctctgcctaggacttccagtctatgttgactaggaatggtgagagatggcatccttgtcttgttttggttttcaaggggaatgcttccaggttttgcccattcagtatgatgttggctgtgagtttgtcatagatggctcttcttattttgaaatatgttcctttaatgtctagtttgttgaggggttttaacatgaaggacatcgaattgtaccagaagacttttctgcatctattgagatagtcatgtggtttttgttttcagttctgtttatgtagtagatcgcatttatgtatttgtgattattgaaccaaccttgcatcctgggataaagcctgcttgagtgtggttgattagctttttcacgtgctgcaggattcagtttgctagtattttgttgagaatttttacatctgtgttcatcaaggatattggcctgaagatttttttgttgtatttctgccaggttttggtatcaggatgaagctggcctcatagaatcagttggagaggagttcctcctcctcaattttttggagtagtttcagttagaatggtacaagctattctttatgcatctggtggaatttggctgtgaatcattcttgtcctgggtcctttatggttggtaggctttttattactgatttaattttggaactctttattggtctgtccagggattcaatttctccctggctcaatcttgggagtttgtatgtttccaggaatgtattcatttattttaggttttctagtctatgtgcatagaggtgttcatagcagtctctgagggttttttatatttctgtggggttggtggtaatgtcttttttggcatttatgattgtttatttggatcttctctctttttctctttattagcctagctagtggtctatcatatttcttatgtcaaaaaaccaactcttgtactcattgatcttttgtatggtttttttgcctcttagtttccttcatttcagctctgattttagttatttcttgtcttttgctagctttgggtttgttttgtattgtttctctagttcctctaggtgtaatgttaggttgctaatttgagattttatgaatttttgatgtggacctttagcactataaactttcctcttagcactactttagctgtgtcctagagattctggtatgttttcttggttctcagtagttccagagaatttcttgatgtctgccataatttcattgtttacccaaaagtcattcaggaccaggttgtttaatttccatccaattgtatggttttgagcgattttcttagtattgatttttatttttattgcattatggcctgagagtgtggttggtatggtttcattttttttagattttctgaggattgttttatgtccaattgtgtggttgattttagagtatgtgctatgtacagataagaagatggtatattctgttccttttgggtagggcattttgtagatgtctaatagttccatttggtgaagtgttaagtttagatcctgaaaatctttgttaattttctgactggatggtctatctaaaaactgtcagtagggtgttgaagtctcccactattattgtgtgggaatctaagtctctttgtaggtctctaagaactcgctttatgaatccgggtactcctgtgttgggtgcatatatatttaggatagttaggcattcttgttgaattgaaccctttaccattacgtaatgtccttccttgtcttttttgatctttgttagcttaaagtatgttttgtctgaaataacaacccctgcttttttctgactgccatttgcttggtagattttcctctatccctttactttgagcctatgggtgtcattacatgtgagatgggtctcttgaagacagcataccattcagtcctgcttctttatacagcttgccactctgtgccttttaattggagcatttagccaatttacattcaagtttaatatttatgtgtgtggatttgatcctttcatcatgtttctagctggctattgtgcatacttgtttgtgtggttgctttatagggtcaacagtttgtatacttaagtgtctttttgtagtagcttataacagtctttgctttccatatttagcactcctttcaggacctcttgtaaggcaggtctggtggtcataaattcccttagcatttgcttatcgggaaagaatctaatttctcctaggtttatgaagcttagtttggctggatatgaaattcttgcttggaaattgttttatttagtaaggctgaatatagacccccaatttcttctggcttgtaaggtttctattgaaaggtcctctgttagcctgatggggtttcctttgtaggtgacatgccccttctctccagttgcctttcactttttcccttttctttcagccttggagaatctaattatgtgtcttggccatggtctttttgtgtagtatctcacgctggttctctgcatttcctgaatttgtattttggcctctctagtgaggctggggacgttttcatgggtgatattctgaaatatattttccaagttgcttgctctctccttatctcttgcagggatactaatgaattggagatttggtctctttacataatcctttattttttgagtgttttgttcattttctttctctgactgagttagttcagagaaccagtcattgagctctcagattctttcctgaacttggtctattcttctgttaatacttgcaattacattatgaaattcttgtagtgtgttttccactctatcagatcagttagagtctttttttttttttttaagacagagtcttgctctattgcccaggctggagtgcagtggcacaatcttggctcactgcaacctccgcctccctggtttgagcgattatcctgcctcagcctcctgagtagctgggactacaggtgctgggagcccaggtcaagaggcactgcccagtgaagagtagtggaggcatgtggacaagtctggctgcttttccataaagtggctgtgttgtgctagaggtttgtatcggtccccaaccactatatgtcctctcaatcccaagggcaacaggagcaagggctgcagggcagcaaaaatggtggcctgcttgctccttctgtgagctctgtcccagaaaagcacagagctgctactagcctgagagcctaggtagggggtggctagagaccccggtagggagacactgcccagagaaccatagcagggttggggacccatgtagaaaacagtctgctgcttttctgtaaggtggctgcactgtgctaggggttcatggtagtccctaatcactgtgtaccctcctgatcttgagggcatcagtggggaaggttgtagggcaacaaacatggtggcctgcctttcccactgagagctctgtcccagggaagtggagagctggtagtggcctaagagtccagtgtggggtggttgaggttctaggtcaggaggccttgctcagtgagaagtagcaggggtgggggctcctgtgtaaaacaatctggctacttttccttaaggtggctgccttttactgagtgtctacgattgcccctaatcactgagtacactccccagcctgagggcaaacaggagggagggttgtggatgtggtctgcctctccctctagaagcttgtcccagaaaagcacagagctgctcctgatccgagaattctggtagggctgtggtggtctcactagtgtcccaggcccatgggtcttatcctgcaaggtgctgcagagacgaggcctgtagcaccttgcaggataaggtctactgggcctagttactcttcagccacatggattcagcccctttcctggagacgtgagggagcctggcctcctccattgctagagctgcatctgctggtgttgaggtgcctggggatccagcactcctgggagtctgtgagtacctgagtgatggctctgccaagactccacataactctttgcatgtttgtctggaagccctggttgcagggatcatgagaaatctcctgatcctgagtccaaggatgcaaaggtccatgacagaagtgtgaatccctggggactctcactcactcactgttccctgtgatgtgaggactcctctggctccatgccacttctgggtgggcaattgtcctgtcttgctcttctctgttcactgtgggtgatgctgtttccctgataaatccccatgtttccacctggatgttctggttgaagagctagtgtccattcaccactgtttcttctctccatgagagtggtgcttattacccacttctactcagctatctcacgccaaatctctaaacttagtctttttttttaagag

SEQ ID NO: 1912 - DNA, 6834 bp, Homo sapiens
acaaacattgaacactttttgatatatatgagatacaattttaaaggatatatagaggttataattttgaagtagcttatcaatttattcttttatattcttgcttttggattcttctaagaaatctttttatcatgaatgtcttgtgaattcagtcaaatccttttactgcatcaattaaaactgtattagtccattctcaaactactctaaagacatgtctgagattgggtaatttatgaagaaaagaggtttaatttactcacagttctgcaggctgtgctggaagcaaagctgggaggcctcaggaaacttacaatcatggtggaaggtgaaggggaagcaagcacatcttactatggtggaacaggagatatttgtccattttaaaattttcttcctgtgattgatttctagttttatactattgtgatcaggaaaggtacttgatatgatttcaatcagctaagatttggtctaacatgttatctgttctgaagaatgtctcacatgtgctggagaagaatgtgtattcttctgctgttgaatggaatattctgtatgtgtccgttagatccatctgcactaacatatagttcaggtccaattttctttactgattttttgtctagataatgtatctattgttgaaagtgagagtgttgaaatgccctacttttattgaattgccatttgtatctcccttcagttgtgttaatatttgctttacatatttaggtattctgatattgggcacatatgtattcatagttgttatatcttcttgatggattgacttctttattgttatttaatgatcctctttgtcttatgacagtttttaacttaaagtctgttctcttctgatataattaagctacctctgctctattttagcttccatttttatagaaattcatgttcatcccttcactttcagcctatgtgtaaggctaaagttaatctcttgtaggcagcatatagttggatcttaatttttgatccattcagccactcttccttttgtttggagaatttaaacaatttacatttaaagtaatgattagtaggtacaaatttacaatgctatttttattttctggttatttttaatggattctttgtccttcctttcttgcttgctgtgttcccttgtgctttgttgattttctgtagtgatatgctttgattcttttctctttatctcatatatacctactatgtttctgttttacaactacgatgaggcttacgtggaacatcttatacttaataacagtctatttagaaatgataacaactcaacttcaatttcattcaaaatctctaccattttacctgtcactctcctccagcacacattttatatttatatatattttatattgtgaatttattaacaaaacaacaaaatattatacctatagttacttttaatacttttgtcttttgacctttatactggacttaaagttgatttatacaccatcatttcagtactacaatattgtgaatttaactataaatttacatttataagtatattttatgcttttatatgatttcatgttactaattaacacccttccatgttagcttaatttaagatccctttagcatttcttgtaagacaggtctagtggtgatgaacttcatcatcacttttgtttgtctgtgaaagtatctctccttcatttctgaagaacaattttgctagatacggtattgttggatggcagttttttttttttctttttgcgctttgaataaatcatcccattctctggtgctgtatggtttctgctgagaagtgttctgttagcactattactgttcccttgtatgtaacaagttactattctcttactgctttcaattttttttaatgtttggcagtttgattataatgtgtctgtgtgaagctgtcttttggattgaatctgtttgggaacctttgaacttcataaatctggatatgtatatttctctcaaggttatcaaagttttcaaccattatttctttaaatgtactctctgtccctttctctctcttcctctgaatctcccataatgtgactattggttctcttgatagtgttcaataagggtttcttttctgttttttgttattttcagtgttctatagggtttctttcctcttttctattcttatctattttttgtactctgatagtataatttcaaaagatctgtcttcaagttttcaaattttttcttttgcttgatcaagtcggctagcagagctctctactgcattttttctttcattcattattcttttagctccagaatttctacttggttcttttttgtgatttctttttgttgaactttaaattttattcacgtattattttccattgtttcttgagttgtctgtttactcttgtgtcttgctcagcttgagcttccttaaaagaattaaaataattattttgaatttgaaaaataattattttgaatcatttttcagataactaatagatctccattttgttgaggtcagttcctggatagctattgtgttcctttgccagtgttatcattccctgcttttttgtgtttttagtgaacttgcattgatgtttgtatatttgaggcaacaagtcacctgatctggtctttttgaagtagatacagtggggaaatgctttcagctgtgaatggctacaagggcaccagctggatggggtgcaacatctcctgttttaagaaagacacaggtatggtctcaatgcagtttaatcagccgaagtcagtgttggcaaatactgcaggtatccatggcagaagccaaagttgcagatgtctgtagtaactgtagtggttaaggctgttaaggtcctcagtattgaaagctgttgagtttctcctattcaacttttatctcacatagggaagttccagccaaagtgattcctcttggcactaagtctgatgtgctggcacacatgcagctgtggtggtgttgggatcctggccactggtgcacagtcagcaatgctggttctgggtgcaggtgcccagagcagccatgaagccagggctctgtggtcagaggcacatgtaactgaggtggtgcctggggcacaggtgcattttttttatttggcattgacaccaatgtctgaggcctgggcatatacagattgcctatagagtgagaacctgtgtcatctttggggaatgccatgatgacttggtcccaggggtgatgagacatagtaatagcatggaacatagcagtaacgtgggtccagcgacaacagggtgtatcagaggcctgtcaggtcacgacaggggcaggatgcagagcagtagtctgaagccccagtgaaagtaggtaaaagccctgacttataacccaaggtaagagagcagtcagttatttacttatgaatatacaactgcttcatcatcatttgttgaagattatatatgtttcttagcacttttgtcaaatattatttgaccatgtatgtgtgagtttatttccaggtactcatctgttctaccaatatctaggtctgtctttataccaataccggcctgtcttgattcctgtacttttaattaagtcttaagattatatagtctgtatcctcaaactttcttatttttcagaacaatttgggctattctaggtctattatacttctctatatattttacaatcatgttttaagtttcttaagtaaaaaagaagtctgctgggattttgtttgaaattgctgtgaatttgtagatcagtttggggaaaagtaacaatattgaattttctaaccattaagcaaggtacatctttcaatttacttaagtcttctttaatttctctcaacaataattataatttttaatgtacagattttccacatttgctgttaaatttattcatatgtatttcataattgcaatgccactatgaatgttgattcaagagttccataaattttagttcagtgaaggaggttcacagtgtcgcttacaaattctatatccctactgatttgttttctctgattattctatcagttattaaaagaggaatgtttgcatactacaccttaattgtagatttgtctattttccctttcagttctattggttttcatgaattttgaagctttattataagatgaatccacatttaggattgctatatcttcttaagaaattgattccttaatcattctccctatatatctctcaaaatttcctttttctgaaatagactttgtctatattagtatagtcgtttcagcattttttaaattagtgttttcattgtaaatgttttccatcatttcgctttatatttaaagtggatttgttgtaggcaccatatagttgggtcttactttttatccactcaggcaatctctgcccataattggagtgtttcagtcatttacattaatatacttatctatgtgattgggcttaagccaaacattttctaatttgtttttctctttgtccccccactcccccttttttttttcttctttttctctgccttcttctcagggaaagattgcatatcttttaatgattctattttaacttcattattgatttattagatatacttcttttagttttttgttctcaggcttacaatatgtatctttgaattatcaaataagtagataaataaatggaatgataccacttttcatatattttaataactttacaacagcatgcttctatttatcctcctgttttttgcattattgtcataaatttacttccatatgttataaaccgcataatacattgttattaattttactttagtcaattatcctttaaagaaatgagaaaagtctttaatattaattttcatatttaacatttttgttgctcttcattatatagtggagatccatatttccatctggaatcatttttttctgtctaagatttcccttattatttttgtaacccatttatgtgagtgatgaattccttcagcttttgtttttttgcaaaaattcttttccactgcttgaaagatgtatttgctgggtatacaattttaggttgacattatttttatttcttactgcaaagatgccactccatcatcttttggtttgtatagtttcatctaatttttttaatgattttatcattttaatttttacatgtaataaatttttttatctgccagcttttaacattttctctttgttattagttgttttcagcaatatgattatgatgcctttttgtttttcttcattcttattctgcttgggatctttaagtttctattatctgcaggcttattactgtcttcaaattttgtctgtcatttatataaattggctatcattttttcaaatatgttttcttttgttcttcctttatgaaactccaattatggagttttgttttttaaagttttaaagatctcatttcattttaggtaatttctgttatttcttcaagtttactgtcttagtctgggatgttgtaaacaaatatactataaattgggtagcttataaacaacagaaatttatttctcacaattctgaaggctgagaagtctaatatcaaggcaccagtagatttgatgtctggtgagaacctgttccttatagatagtaccttctaaattcatcgtcacataatggaaggggtgaggcagctctctagggcctcttttataagggctctaattttatccatgagagctccattttcatgacctagtcaccttccaaagttcccacctcttaatacaatcatcttgggggttaagttttaacgtattaattttgggaaaacacaaacattcagaggatagcattctctattcttttctactataatgtctaatgtgcagataatgtttaaatttcatatacatttatatctctaaggcttttttatgtcttccattccttcctttgtcacatttgtattttcctcaaccttcttgattatctgtaatatgctttgaaaagcactttcattattttccatctgctagttttatcatctctttcatttctggatatgtttctattgagctattttttcctctggttatcatattttcctgattctttatatgcctgctactttttatatactagatattgtgaattttacgtttttggtggtattttgtgcctttttttagtagtgttcaactttttcctggaatgaaattaagttacttggaatctgtagctaatttgtctcactgctgaagtgacactcctatatctgctgttccatgtattaggagagctctgcagtttcattggtagtagcataaaatattcttagccttgtgtgagctctgggaattgttctgccttatctttttggtggctcttttataggtcttgagtagcttctgcacatggatgcacagattagtacacagccgaagtctcaaggacatctttctgcaaatctctggtattctctctctgtgcagtttattttgccttattagttgtagctgtttttgtagtctcagtctctcatctctgcctcctcaactaaatgagaccatcaatctctctttgagttctagtttcctgtgcccaagcctgggaactatcttcagtcactaacacagaacatttgtgaaatgtattaccttggttgctatccttctctcatcttattctatgttgcctgttgaccaatatgtgaaaactgttgtttaatatatttttgcccacttttctagtaatttaaaataggagattaaatcttttctctttaccaactttctgacaactactgcctgacttccccagccctaagctataacttctcagtatt

SEQ ID NO: 1913 - DNA, 2088 bp, Homo sapiens
acctttctgcactatctgtaattcctaaccttaaatatgcatttccttattagcactgtcaataagtgttagctaaatgaggaaactatggtctgttttcttcttaataagtctgtttttagaagtaataatgaggaagcaatctaataaacgttattttttgttgtcgttgttttttgagacggagtctctctctctgtcacccaggctggaatgcagtggcacgatctcagctcactgcaacctctgcctcccgggttcaagcaatcctcctgcctcagcctcctgagtaactgggattacaggcatgcgccaccatgcccagctaatttttgtatttttagtagagatggcgtttcaccatgttgttaaggctggtctcaacctcctgaccttgtcatccgcccgcttcagcctcccaaagtgctgggattacaggtgagaaccaccgtgcccggccaaatgttatgtttttaaggaagaaaattcaaagcaaaatgctatgttgaaaactgacatgagttatgtctttttatgagctttcaattactttattttcttacccttgcaggtcagtgatcctccaaagataaaagaaaaacactgtgccacaggttagaattttttctgccagaaagctagacactgcaccagaccatctttaaagacgccgtccatatcagtcacgggctgagttgcaatcctagttttccgctgattattactgagaagcataccacatctgtcagccacaggacactgcaaatcttctactgccacagagttcagtatggcagtgacttaggcttcggcacacaagtcagccatgacaggttggtttgtagggtttatctacgcattctgatggtccctacacattttccagatgtgttgacctcataaaactgccacctaccccaggctgtgaaagaactgctccaaccatatttttcccacccctcaactctagcaacaccttgggttccctggctgggcgaccccctaagatatgaagctgggttggctgtcagtcctgagccctgacaagagaataacagcagggtggccgggcagccaggcatttttgcatccgcccagtgctgggaactgacgcattcctcgttccctggggcctaaggttctgcttggttttgggtccctgcaagattggggccctgcctactttctcaaccagtttatccttcaaccctctccctcaggccccaaaagttgctgctgaaggtccctgtcaacaggcaaacagtcaacccactacagacactcactcaccctgcctccaggccctctctctgcctggggcctcgtgttacacctgcctaaagtgcagcgcctggccttcctccccctgcctctggttaggatctccattctccctcgatcccctcttcttccactgtgacactctggtttccagatccttattcctcttccctccaggtcatgccctggcccattcttgatcaacttcgagttacagaatcagctctctcatacaagcattctgaacaggtcactggggtatggtagatacttgtagtatattttcttcaaaaagttacaaacagatttaactgaggaatcaatccaaaatcgagaatatcatctttcttggtgctgcctaggtacaaagcactttgtatatcttccgaggatgcaaagatatgacagtccccttcccttaaggagtttgaaatttagtagagaaaaaacaaattcagaaataactataaatcatccaaagcaaagaataccatgtaacacaagagaggttaaaagtgccagagtgtagaggatgaagagatcatctccaattggggaaactcaggaaaagattcatgaatgaggcagcacctgtggctgatactgatgaatgaccaggatttttatggggtaggacagaggccacagtttctgactaagaaaaagtatatttttcaaatcttctatattaaataatgagcaaatctggcctcttgtcaatatgttctttctaatcagctggctttttgtctgaaacactacattatatcacccaacactgtacagagaaagaatgccttctaggta

SEQ ID NO: 1914 - DNA, 2919 bp, Homo sapiens
agtcatcgttcaacaaaatctcagtaacgtcacaaaaatctcaatacttcagatttacaaaaatctcaataacttatcacacatgctcctgtccaggttcattcattttaatcatataatacatgatgatttatttgtatttataaattatgtatactgttaatatctgaatggtaaatgacatgattcttttgattgtcattaaaataaagaggtacacctgaagcaaggtgggggcactccacttaataattgcacttaatgataatcgctaccagctattgagctactgagcacgacacggactttaaatattatcactcaaaaggttttcatggtgaaaagcaaaccatgtaaaaaatgttcattacaatccatcatgatcaaaatttcaatgtgttaagatgttatcttcagtaatagttgcaaaataattgcggtacagcatttagttctttcttccagttaagtgacaggcaaactgtacagcttcacaggttctactaagcacggacgacaatctgaaatagtccactaatgtccctccaagctcagatccctagcacatattggagttagggacttcagcccaggccagagaaaagctcagtacacacatctaaaggcttggacgtctacagatgagccagtctcaatctctctcttgcacgcacgtatgcacgcgcacacacacacagctgaaacatggctccaaagtcccatccttcatcctataataactgtctctctcttctcaagtaggatcagccaaccactaaaaagcaccctgttaattagaacctagacaatctgtctttaatctgatacaatgcctaagtagcccaaaaatgctgaatttcaacgttttgaaggatttattctatgctaataaagaactgggggccaagtgtgggggctcacacctgtaatcttagcacttggggaagctgaggcaggaggactgcttaagtgtaagagctcaagacctgcccaaggccaggcacgatggctcacgcctgtaatcccaacacttcgggaggccaaggtgggtggatcacctgaggtcaggagtttgagaccagcctggccaacatggcgaaaccctgtctctactaaaaatacaaaaattagctgggcgtggtggtcggcacctgtggtcctagctacctgggaggctgaggcaggagaattgcttgaacctaggaggcagaggttgcagtgagccaagatcgtgccactgcactccagcctgggtcacaaagcaaaactccatcttgaaaacaataaataaataaaactaaaaactaaagacctgcctgggcaacacagtgagaccttgtctctagtaaaaatttaaaaaattagccaggcatggtggcacatgcctgtggtcttagctactcaggaggctgaggtgggaggatcgcttgagcctgggaggtagaggctgcagtgaccttatggttgaaccactgcactccagcctgggtgacagtgcgagactgtctcaaaaaataaagtaaaataaagaatgatggtggtaaaatttatcctctgaagattttcagaggttttacactgagcaaacaaaataattcaatataagttatatcttgtaagagacacacctagtattaccagtctatctcttactagatataacttatattacctagtattaccagtgtatctcttactagttaagagatagaaagatagtctgaaattcccattttaccactaattacctttgaatttctgtgatttttataactactttcagcttcccaaagttcacatttcctatttgctcggttggaagtaagagagttgctatctagaggcttctgggtattccccaatttgcaaagagaatgaattccaaaagtgtattcgtggcttagttgttcagaactcaaggatgcccaaatacatgttcccatagaaataacgttgtatatgtggcagacccgttcccaggtggcccatgagatctatcacaccatgtcacaggagtagcagtcttgatccagccacacctgatcactatgcacaacagtctgaacccgagtctgctgtgtgatgccaggaacacgcctccccagtgtggcaggcagtcacctgggcatcctgagacttgtgtgttgaaggagcaggacaaaaatccatgtcggtatttctgctataatgtgatatatacattcctgaaaaatctcacatcctacaaaatcacacttgaaaaataacgggatgaaaaaggctgttggggtagaccactaaatccctctgtaactctgtaaccagagcactaaccaaaagaataattaatacctagggagatgacttggacagcctaggcaagcagcttggctgtggctgcggctgcctcgagggatattaaacacacaaatgacagagtggcaactgttggctcacagacagagtggagttctgagccaggagctatgttaaggtggacacagagggaagatgcctgctgggagcccagagtcctagaaggctagcgggtgcctgtcctggagagaaagcgctgggtgcaggcactcatttttaattttcttaaaatagagttgaaaagcgtgtctgctgcctgtgaggttctttcctttcttgctgaaggctgtaactctactccggcaattcctgctcctctggccaaagaaaaactgcttctggatcaatctaacctccaggatatactgacatcattcctctgcttttcagttgagctgactcgtgctatggacccaagggctgtagcacacagaactgcactcctaggaccagtggctgctgactcctcagagttctcacctggttagagaaggccctttccaagtctcccatttctaaaaactctgaatcagagaacagggggtagtcatcctgtgagaggta

SEQ ID NO: 1915 - DNA, 19763 bp, Homo sapiens
ctcctaaagggtgaaacatctcagatgaaaaacctcactaaccaaaactcctaattactaaataaaacttaaggcattcataaacgcttgaatgtctgaaattgcaagtctatacagttgaaaatgcattttctgaattcagatatttgcccttgctacataataactgtagaatgttgagcaaattacttaaactcagtgtctcatttgtcttatctgtaaaattggaataagactagcactgcctcatagacttattttgaggattagagtgacttaataaatatcaatactcttggaacgatgcctggcaaaattattattgttttgccttgttgttatcttagataggttgtccctataccatgccaaaactattctgtcaatttgagggggaaaaattaagagtcaaaatagcaagttggtgcttgaacatttactttccttttggttattttatcattgtgtcaaagaattacaaacaacataatccctattttcaaaacttccttagccctctgatcttcccagagtcacagaaagtagtagttgaatggctttaatctagtttgtcttagtaatagaccaacaatccatcaagaaacaaatgccattctatggccctagttagatagaattcatgattgttttttcccctaggactgcattgcaacctcagacaagaatggcagacagccagcaggttctgccagctggctttgcactgctctctgggttttagagaacaggagcacagatatttttgattctgcaggccaattcaagcataatttacagtgaagaagaaaccctttaatagtgatttcgcatgtagagaaattatatttttaatataaaagaacatcacaattttttaacatgcgtgcatttgaaatggatacttacaaattatcagctaacatgggacatttctttaaaaagcatgttttccaacaattgattgcaaatccagtaaagatataaaatgacctgttggttttgagatattttattcattcatctcttcaatacatctttagtgagtgtctactatttgctcaacactggcatgactctgtattaactttattattgacagctttgatgtggcacattctgctgtaatattgttgcttatactatactaatagtggaaactattgctcactaactataactagtttaaaataaaatctgagattaaaatttagcatttaactttcttaataattgagattattgctgaaatcattatgaatgtttttagtgtagggaactttgccttgtccctcagtgtactagaacagtgcctgacagttaagagtgcaatgtaataactaattcagtaaataagtatgaaaatctaagaaatgcagaatgtcaattagaggaattatgctaatgatgaaaggctacgaaccctggaaaaaattttcatttcaaaaatatacataatattctcgaaatataatttttatttatatttaaaaagatgtgcataatttgtattaaatacatatgaatgtattataaggtaaaaaagatgcatgtctatatttaagtgtgggtggagagaaatacaatctactctatttaaaagtttctaaaatgtacttgtgaaatattaatatttttcacctaaaagagttttttcttttttcttattcaagaaagttttctctttgaaatttaatgtagcgcttaaaaatattcagtgctttgtttaatacgcaaacttagcataattggattttgtgagcctggctcttaaaacactatgtgaaaactttttctctaatacacttagttcaatatgctttatactttttatcaaaactttgtaatgaattttaaaataattttatagctagattattttataggtaacacaaaatattttccaagatgaagttctttgaagcaaagtcattaattttgttatataattgaatttagctcctactttttaatctaagttacttttagaaatataaattagaaagtcatatgaatagatagactccttattgaaagtaaagtagcattatcttgtaattgtacagtaagaccaaacgcaaatgtgacaaaccaggttaatcaaataaatggtcattgaaaattgctattaaatgtgtaagtggtgactaagagaggctgaggtaatgataattatatttccatagttttctgataaagtagatgttttggatggaaaaaatactgaggtgatgtttatttacttattattttattctttcatttaacaaatattgatttaaattgacgctttgccaggcactcttctattactaatactaaatttgtgaacaagccagataacaaaactgctctcagggaacttaaatctgggaggagaaggcagatgttaatacattataactatggtgaaatcaggtggatttaattgtgagaagaaaataagaaagaccagaaaatgatgtggggagacagggccaatttagattgaatagtcaaggaagtctcctttgaactgagatccaatgacaagatgccagccattacaagattgtgagtcctattctctaggcaaaagaaagagccaaatgttccaagggagagagctgatctcggtgtgtctgaaaaatggagagaaggcacattagagtggagcatggagaactggaggaaggaagtggagaagaggctagagcacatgcaaagtacaccacatagggccttgtaggccatggaaagaactggactgaactacaagtatcatgaattgtgaacagcatattggtactatttataattttagaaatttcttttatgtggaacaatagctgttctatactttttatagttacatgaatttggattcctgttggtgaacattcttatttcttaatttgaatactcaataccatcaaaatgcatgtaatttttaattcattgcggtttgtcagaacactagaggcaattaaaatcatttgacatagtattttcctttttatccttttacatgaatgcatttttcagttatttcaaaattcaattgaacaaaatctaaaccatttatttcactatatccttcataaaacatcacactttttaaaacttgtatggatatgtatctctatctgtttgattttatattaatccattgcttctctaaccagaaagaatagtagtgaacaatatcttttcaggttaatgatttaatgtgtcatgaaatttttcatgaagtgtatcatgaaatgtttcatgatgataaaactacttattttctaaaaacattaactttgaattgaatgtggacctcctaaaatatttttttccaaaaagaaagtcttcttccatgaatgatgaagattagtgttggttactgagttcgagattttattttggtgtagtattttttcccttttcttcattttccagacatgaatgtctgccaaacacacactgtatttaaacccctgagaagttcaaaagggattggagacagcaaagggaggtcttttatatttcaatatcctctgtaattaacatttctgtcttagcattaataaaactaagcttttgcctacttttgcttttgattttagtggttgaagccattattatttgtgcaaaaagacaatctagtaacacaagtgtaaattggagggtaatttgaagagataatttgctgttgtgaaaacaagtccaaatatttgttcatgtagttgttggcaaaatggtgatcatagaccaatccaattctcctcagacaccaactggttgttgttgagtgcttggccttcacagtagtcatgtgatcaaactccatcatacatgcttgaaacatctttaaaaatggagagtactcttaatggatgaaatgtggatgctgcctccttacctctacattcctaaaaataatctacattcctaaaaatacacttcaaactggaaaccatcattctcagcaaaccaacacaagaatagaaaaccaaacactgcatattctcactcataagtgggaactgaacaataagaacacatggacacagggaggcgaacatcacacactggagcctgtcatagggtgggggatgggagggagggatagcattaggagaaatacctaatgtagatgattggttgaggggtgcagcaaaccaccatggcacatgtatacctatgtaacaaacctgcacgttctgcacatgtaccccagaacttaaagtataataataaatatgtatatatatatatatactttaatactgattatgctgatcatataatcgcaattacacacatagtgttgatcttatgtgtgtaactatgcccactgattcttgaaaaaatgacaatacatttgtttacataaattgtaaagaatccaattgaaagcaagctcaacatatagagtagtaaaaacatgaagtgtatcttagggacatctctgtaccttccacatagggcaatataataggtcacaatttataaacagccatctaccagtgttagttccttataaacaatgatgcaaactagtgtaggtaatataaactgaaaatatggaaaagaaaaaataatttgtcagtaataacagccctcactttgaactatagcaatactattgatgaatatcagtattattatattttttccaggaggtttctcatttttctagaaagtggtagaccttgagttttttaacaaccaaataaataaatatacaaaatcaaattaaacataagaaatttaagtttatttttttcattgatgtgggtgcacacacattaactgtaaagcagaagtaaattgatagttggttattttactggcaactgtgttttgtttgatcttgacatctgatactcatgaaatttgtagcgtgctgtgaaagactctgacactattaaaaatttgaagctccaaataaacatactggatgcaccattttctgaaagtcatttgtgagattatgtactaaagcaagggtcttaatttcaagtcttaactattcaaactctactaacgtaagttctgaaagaggaattagggtcatagtattaaatcagctggatttggctacaattttacagaatcaattcttaactcagaaaattgtcaaaattcatttatcttatacctcatgtgaaagtagtatggcagttcatagaagtaaaataaaaaatcgtcaaatctgaaatttatctttcaaataaatgtagatacttttttgtgttttatcttaaaaagagttttgtgttttatattaaaaaaagagaaaaatctcaaaatatttatacatatacaaaatatatatacaaatatatattatatgtatatatatttttgagatggagtctcactgtgtcgctcaggctggagcacagtggcacgatcttggctcactgcaacctctgcctcctgggttcaagctatcgtcctgcctcagcctcctgtgtagcctgggattacaggcacgcaccaccatgcccagctaatttttgtaattttagtagagatgggttttcgccatgttggtcaggctggcctcgaactactgacttcgtgatctgcccgcctcggcctcccaaagtgctgggattacaggcgtgacccaccgcacctggataaaatatttgtatattttatatgtaacacttgttttataattatctgtacaattcaataggcttttattctttctgcattctataaaaaggttttctttattggttaaagagatacacatatattaatttcaaaaattgctgaatgaacatgatttacaatattctgaatatttaataggtatgtatatttatcataatcttgaatgacaaattataagatagttatacataaattaatttataaatgtgccaagaattttcttatagtttttgaccatattttataaaaagaaatttttgtaccttttaagctagaggacaattctcttaccccattattttttttctattaaaaaatcacatattattaaagaatcacagttgaatctgtattacagaaaacttgatctgtctcattaatggaaccaagtaactactgtattcagtaagaaaaataataatttaaacagctatatatcataacagttattagaatccccggtaaccaaaatttagtcataaaccaaatttactaatttttgtttttatagtgaaatgttacaatttaaaaaacaaactggaaacactagtgtgtattgaatttgaatttatatttttatagacaatgttttcctataaatatttgtgagattttaaattggtcatgatctgcatatgacttagccttatgatacttctatattaagttacatgtgatttatccattggaaagctaatggaaagcttagatacattgaagagagacactattaacgtgtaaaaatataaaatttgaattttttagtaagtattcaatgagcacctactctggaaaaaaataatgtactggatctttggagaacatggatgtataaaacatcataacctctattcaccagttttcgagtatctcgacctaactctgcccaaggatgaaactcattaattctagagtagctcatgatacgtaagtcaacctgaaacacagaaaaactatctttatatggaaaacttttaaaaagaaaagtgctgcaagataatgttatttgacatttgaagggaagagatacatattccattgttcaaaaatgatgcaaaatctgctccattacatgagtaatattatatgagccatagtctatacaacataaaaatacacaagtggacattcttagtgttctaataacatacatacaattttaacctgaaagatcaaattatatatataattgtcattggcaattaggcataatagaactaaatgttttagaagagattttatttttttggtaaaagatttcaaagtttaaatagaatcaactttcacttaaatccatttaatagtttgtaatattgtcctatcttgagtctcaattatcattgtatttaatcatcttataataagaaggccaaatatgaattaagcaatctcctaagatatctcataaaactgtagcttttttgttgttattgttcttacctgaatacatccaatagtaggcactgattacttggtaaggcaattttttgttccaggaccattctaatcttgagaaatgtcttcctgttttctgtgggccagaaaagtttatcatctttctttagtaacatgttgccatgattttaaagagattaattatctggggccagcccatagttccttcttagtagaagtacagaaatcccgcggggggcgggaactgacttacctacacacttccacataacatacaatgggttttgccattaagatcagctttaggagtaagaatccaccaatttcatggagaattggaaactctccctatccaaattatctaacttgtatgttgacagtggtgtcccggtggtaattgaaggaaaacagttgtaatagtaatagctaaattgtcttgaacactcactaatatcagctttacattcaatgtttccttcaaagtcatacaatttatgtttactaaaattccttaagcaggaatggttgggagaaaggtaaaccatctattcttctcccctaaccttttattacatggcatctacaatatattggattttgattttcttactgttgtttattttcattttatttcagtttcaataaaataaacctaaatacctgaacattggactattattccttttaagggaaatgacctaggaaaagtaaagatagagttttttgacctttttaatttttttttaaattacagcacattacaaggctattaaaagtgttgtaaataatgtaaaatctatttaaaactctaatatggagaaaaattactctaattatatgtgctgcagcatcaaggaagttttttcccccaaagggcttctcatatttcataaacactgatgagttttcccttcaccgaagtaacatcaaaattatatttgtaatttagaagtaagtctccttgtcagtatatttcaaggaatctgaagaaataaaagcactatttttagcatactccaatcaagccagtaaataaagatatggaatatataaatataaagaaatttgtgtatttagaaagtacaattataaaagaggttcctttcaatagaagatgatttattgaattattttctataacattaagaaagtcttgaaatagaaaaaaaaacaaaatgaaatcaaatattaagttctggtgattgattttattgtaggcttttgtgtatgtattcaaaaagtaggaagatgttctgagggaaaaatgtatttcctcatgacaagtggaagttcattcaagtatttaacaaatactggtgagtacctgccaagtacctgattctaagggctgaagatatagcagtgcccagaacagaaaaagataccaaccttcatttagtttatgggataatagagagaagcagatagatgtactaagttgtaaaatatttagtatgtcagactctaaaattctatagagaaaagaaagggaaaaaggccgtaacagcagtaaatacatgagttgtctgtgggccacaaattcatgcgacagcattcaagttgtgagggatacactggaagtcctggcctcttgtggaaattagagtaaacagaggattcattctgcctgtcttgatgcaggtcgtggacagactgggggtgtctgtcctggtgtaagaaatgaccagagtcctgccaggaagaagcagtgttctgggctctatctttactctgctagagcaccacggtatccctaggccgtattgatcattctgtcattttcaggttaacatctcatcaccaaaacatttattttagtgcctactgtgtcaaacgttatgctatatcttgtgcatacaaagaaaattaagacttcataaccgcacatgaaaagcttaattctggcactttaataatacctactgctataacttttgatgtaaattatttaaagataagattttcatgttgtatttattaaagtgtacatttatggcaaagtgtgtttagacagggaatttaacatttattgaggtcctcctcttgtttgggtttgtggtaggtgcttcaggtacattaccttataaaatcaccttaaaacattatcttcagttgggtgtcatgtttcccattttaaaagaagaaaaaaaaagatatgcaagttcataaagcaagcaagtggcaaagcagacaattgaatcttaagtattcatttattctttctgtcaaaataggatgcctgcaaaaaccaccccataaaatagattcattctgtagcttgataatattatcataattacctatacaatatggaaaaatcaattagtttatatgaaaatacattaaatcagaatatattacataatacataaatagatttatgtataaatcagaatatattacataatatattatatattagctctctgggatatcacttgtctagttaaggaccaagagattgagtttctctagcaaagcaaaatgattacgtttcggtaatgattcttagagatttacatcgtcaaagcagttctttccagaagttgcatacttattagagcattcaacactaaattcttctcttatgtactgatgaaagtatccgaagatgagctgtctgaaaccaaaatataaaatgccaagtgccgttaggtcaaacactctgatctgcctcccagttattactgtcatgaagctaccttttattttgtcaaatgaaataaaaatgtgagtttgcctatgctttacaaccaaaaaagcatcatcaaaaccacaagttcttaggacttaatagaagcaaaatgatcaagatgactgtttgtacaaagcattgatctgtttctctgctttatactttgaaggtaatgagtaatttaattacctctcaggtatatagagaaaagtttttctccaaacattttctagggtctgaagtatctgaaattgatcagccagcagccgtgtgatcacactgaaagtatgcaaattttggttttgcctaaaggtcaaaataatagaaaatcacaccaagctattaaaatcttactttatttttttgtgtgtttttctcatcttgccagttttcagaaactcaaggaaaataatctgtcaaggattcttcactatctgatcagcctgaggcaaataacttcatctccctctgcctcagtttcctcatatccacaatctccacaattccatgaaaatcctactcattcaactaatattcatggaatttcccatttctaagcacagagggtctttcttaatccattattttagttgaaatactgaatttaaaattacaaattttgaagacggatcagtttttctttttttttttaagtactggttatgttatttctaaatataatgttaccttaagggcacatggtacaacttcaaagaaaccagaagctcaggctacagtctctgtcagttttcataagaacatatctcaacaatataaaactgaacagaactcaacagttcactcttagagcagaatctgtgtcaatcattctgctctaatgatcagtacttaaagccaagatattttccccaaacactaaaatatggttttcccatgttccagtggttatttggtaatatttccactttaccctgtattacaacttctaatatttctataaataaaatagacttaatagaatattgcagtggaaatgaataaaaagaattcatggaaagagtcggcagagtccactattttggcccttagtaaagtcatgacatgtccaggtttaacctcttatctggaatatgcagaaaatcaaatattttttttacttcatttgggattgatcaggttctgggacactgatctctattatatgtttcataaagaaatgatttaacaatcagatcatgttttattaatatataattaaggcatttcaatcaaccaaaagattcctaatccctgcaggacaaagagggcatggaagttgccttttatgacagactctgtattgctcctccctgtggatatggaatgatttctgcccagaaatggctatcttaattggcattgcactgagtaaatatattacagttactgttttttctagcctccatgcattttttgtgctcccattcacaattttattaacttattgtaaatatttccaaggtgaatggttatctaatataagtgtatgattagtttaattactttatgaaattaaagtatgctatgatttatcatccatttatttacaaaacatctcagggtgagttatttctaaattgctttgcttcgtctgtttccttattttctaggtagaaaaataatttattttttttcttattacatcttcaaattgttttcggtatttataattcctttttgctcttaagattctgattaaattctaactgcaacacaaacaataaatataagcttatgctttatccatagggaaaaaaatccagggacatgtatacccccttctatccagagagaattgttatagaaaccattctaaccagacttatttgctgacatatttttcttatggttaaattttggtcctcttataatctaagcctagatagacagagacatagatatagataaagattttgtcctcattgtcctccatgaaggaaaattacagataatgactaatcaatataatatctacttgttttcttgaacattgccatcaccaaactagtactttaataactaacacctatctcaatataatccatttcacttttggttgttgtaattcattttactgcaatcgaataccatgttattctaacttagtcttcaaagtgtcaagtaccacccacaacaggttgttctttcaatttttaaaaaatgtactctctctttaaataatagtcattcataaagttatcagatattactgatgccctagtaccatctccaatattgtttgaccccttcttcctcctctgttcacatatatccagcttggcattatcagcccccaaccctgttgtttcctgctttattcatgtacatccaagaatcactacatttcatatctagaaataaattagaaattgcttcctcaccattgagtgggccccagaactatttacctactaggttgtaagcttcctaaggaagggcagttgtcatcttacatttgtagcccaaatgcctagcatagtccatgtggcatagtaggtgtttaacagatatttgctaagtaaatggatgagtgaataattggataaacaaaagcatgaacttaaaccctgacctccttgcctagttcttatagttcctttattgcatatccagtgtgtcagttcctaaacattcaatttctgcctactgccttgtactaaacctgggttaacttttttagactctaggactcaaataataaaaaggcttagggatttttctgcccttttaattgatttctcagctcatcttaaatccctagatatttacatccatctggttcagactgcaaacatttatttgttgattcattcaattggtgtatattgattttttaatgtaagttgttgaattttgcatgcaacagggagtaaacacgcaacaagcaaagcccttgccttcatgaaaattgcagtctagacaaatagagtaattagataattattgcaaaaacacgcaaagttacaactctgaaaaattctacagaagagggtaaaatataccgtgttctgagagctcatagtaaggaaacttgaccttatcgaagaatctaggctttcaccagtagtgtacatgtgagctgacaccagaaggacaaactggaaataacctagataatgtgcatgggaaagagaatccaggcaaattattgagagggcagacaagagaatgaaaagtcccctgtatgtggaagttcaggcaatgcagaaaggcatgtgtaagaaaagatcaaagtagacatagccagatcatgcagggccttttagattatggtgagattttgtttaagagtaatggaaggccactgaaaggtgttgaacaagagaggaaaatgatcagatttgatttttaaattatcatccaagcttcagtgttgtaaataggtgaaagtagcactaaggtggatgtagacagattagtttgttgtcaagatgagttttctggcttgtacaactagacggatgtgggtgttattcattgagatagaaaacacactgagtgtgtgggaaggctgtgaatttgattttggacatgaatatgtgtttggaaataaatcctaggagagatgtcttatagaaaattgaatatattggttgagagctcagagaaaataatttgtgtttaggtagtaattcaagctgtggatgtggaagaaagtatacaataaaaaaatggagagcctaagactgaaccttggggtgcgccaacatttcatgtctatgtacacgagaataagcctgcaagctgatagaggaaagactaaaataaggcaaatatgtgagagaagacctggaaagacatggtttaagagtgagagaagatgctgtatcaaaaaaaaaacagtctcctttgagatcacctaaaaactgaaaaatgtctgttagatttagtaatatggaagtctttcgggatcccagcaagggctgtttcaatgcagtcatgggaccagtcaacacaatggtgtggggtgaggagataagtaaagacaactccagcctctctgagactttttggtcatgatgttggtgacaccttgggaaagtgaggagacttaaatgctggggaaacatttgcgattgcctcatttctttcactttattctaaacatggtagtgatggagtcctagaggctccccattgggactacctactttgttaaattactaaatgtgatgaatatttgttgacaatagtacctaaaaatttgtattaatagaatcataaagtcttctacaaggctcaaagtccaacataattgatgacatcgtgtctgacttccaatattcatgacttcccaggtgagtttccatatttctgaaagttttctctgtaacacttggaaaatacaatttagaattgggatatataagaaagataatatcagggatggaatgttaggtgtatctgtcatttgtgatattttacaaagtgaaaatagatttattcatatatttttaccccatcttcttcctttcgtattctttttttcttcttgttctctttaagaaatgaatacctaatgtttattccgtactgtacaaggcactagatgataaatagaaaaaggaaattatgagataatgataaatacactgaaattgctgaaaaagaaaggctatgtcagaatgaataaagataaggttaaagagaatagcattgagaggacaggtatgatagatacttttgaatgcaaggctgagacgtggtggagaataaagcagcattgaaaaaaataacatttaacagagatttcctagcagctctgtgaaggtctaaaaataaagagagtttggttattgtaataatctggatatcaattttaggaagtgtatataaatgaaaatcattatgtaatggaagtagtctgaagactcagtaatcaacaggggcatgcaaaggtaaaggcagtgaatttggaaataacaggaactttttaaaaaagatgctttaaaagggagatgttttaaataagtaaaattataattattggcttattgggcatcatgtgttggtaggacatctaagtgttcatataataagcaggagaaaatgctcacacacttggggttgccctgtaactcacctcaaattatcactgggaatacccacttagtaactagcattttctaagagatgctctacattgataaatacaagtgaaaatgtccattgattgaaaatatgttacacatctattagatttatttacataagactggaaagttatattttacttctaattataagtaaagttatttttaatatattcacttctactggatgttattgagtctattcttagattacctaaatagaacatttcaactttgtcacagaaaatgtacacaataatcttgattttccatttaaaattcttatgaagaaggcttatttttaagaactaaattctaaattttatttctctgttcttcatagatatgttttatttaattattgaatttattttgttttctttcaaaataatttttaagcatattcattttgcatcaatctacactcattgtaaaatctaacattgacttatagctattagttaattttaaactaagcaaaatacactctttttgtcttattaattgtgtatttgagaagatccataaactttgaaaaaattctatttcttcaagaaacaatttttaaacttctatataatgaaatattaaatactttattatagttaaggaactttatatattttttctctagatctcataatgatttaaaatccatacatgcttcaaaaatgctttagtatgctcatttctccaattgtttaactgaaaaatatcctgtaatgaggtcagtgattattttttataaaatgcagaattcctcattcattctttactctgaataagtatttaagtagctttttccagtatgagttgtttgtttatgctttgcttgattgataatcagattctttacaacttttatttgatcttgtaaaatatgtgatttatttaacacaatggtgggtacatgaaatgattaaactaatagtaattacagtctaaccattaaccagtgatatagatggtgaacaaatcaaccttatgtatcactagtcacatacatggggatattggaagggtatcttgctatccaaaatatttattgtgtctctaggagtctcataaaaatttaagtatcttgggaaaaatgggtatgttgtaaagggcattgaattgggtttgccttgagaaaatcagttaatttctttaagtttcagtttcttcatttgtgacatacagataataatttttacctatttcacaatgttattctgactataaattagataatataggtaaatttatcaaaataaaaagatgatattaatgttcaattaattattcttttgatcacctatcaaattaatcactaatcaaaattctgaggatatacatatatatatataaaagtaaattttcaaaggggcattgggaaatgattgtggatcttttacattggagaaatgggtattgcagtgaagataccctggaaactatttctgtgagtgggaaaaagatggcttgtggtgctgataatgaagagtgaggtgcataactgggactagaaacacaatggaaaaattctatttcctggtttgtcctggaatctattctgataacagtctatggcctctgcacagatgttttcatatggattagccaccaagcagtttaatgcattaagcctactataacagcaacaaattataatttgtttgtattgatgcacatgttagatagatagatgatagatatgtgagtatagatagatagagcgatagatgatagataggtagataggtagatcgatagagagacagatgtttccacttaaatgccctcatttacataagtttaaatagacatatgaattacagctcaggctgatttgacttcatttatggttcctataccttttgatgtttgcctaaagatatattcagcttaagtgctatattaggaatatttatttttcttcttataaaatctctgaattcaagaatattattttgttttctatgtatttttatgtattaattcatgtaattaaatatgtacacttgtgagatatgtacacagaatacagagtttgtacatatgcagacaattataatacaaaagtgaagattacaaatgccacattagtcatacagaatgtttggggattccaaagagggtgtgatgacttctcacaggtggtgaaagtgggcatcttagaggaagtgtcttctgagctgtgccttgaaagataactagtaatctctttaaaaagatagactggaactcaactatgagctattgaacgttttaaaatagaaaggtgatgtcatcagagagatgctttaggaagattgaagtagtggcttgaaccaggtggactggaaggcagggaatgactctgcaggtaaaaatgcagtcagatcactattttaataatagatcaaaggttcccaagcactgaaccccctgctacagaagcatctgcagagacttttgaactgcaaatttccaggcccctcctcagggcctaattcagtgggtctaagatatagccccagaagtaatattaaaaacctgcagagtgattttgatgcatagccaaggttaagaaccacaggctgcaatgaaaaagctctggcctcgctgatagactcgaaggagggtgagaagacaagacaatggggtcaaaaaagaaaaaaaatgtagaaatgacacagaagatattttctttcctgttgtccaaatttcaaaatgataatttccactatttgaatttaataaaatacacttgccaaaaagtttgtcttatatatgtatttgtctgtattttatctatagatgtattgaatggttcttttcctgccatttttctcttatttaaaaaacaacaaaatttgtctgaataagcttacaatatttcttttttttctatttattctggctagaattttgaaaatgttttaaaattttatgtccttttacaattacattgatatttaaaatgactctgcttcttaccatggatatttttaagaagaaaaatatcagttgatgagaaagaaaaccactatgcttgagaccattttcagggctttgttatctacttttcatcccaaattctatatatttttattaagattccctaatgcataaggatagaaattgtatttgtaaatgctaacttaaaataccagtatttaattatgttgtgttgatagggatgatttattctagactttaatcggatgtttttgtacctaaatgaaatttagtcttattttaattaaatggtagaacatgccaaaaatgatgggtaaaactagaagaaatgaaccccaacggaagactccggtttcagttatcagttttgtagctgtaaagtagttaagctctgtggttgaacctgccagacaggcattaacattatggtataggattcatctgctgagataagattttctcttatttaactttattgaaatgtctgaataaatcactaagccaaacgtatggtttcttgtttaaaatatattaaaatcatggcataaaacaaaattctcatgtgaagtaaataataaaaataattgtgaatgtatcattcaaaacattttttcaataaaaaatgtttgaggagagctcagatttggttactgaaaccaatattcctttgataacttatttctcttttttgtttcaaagttcagactagttaaattgacttatttctctcttatcctacttttttgtagtcttgcaactaaataaatttagttattacttattgatctgttcgcttgaaccatctgacattttttcctattgtgtacatataaaataagcaaagtatcctttatttataaaggacttggttaattgtacccaatgaaactatcaaaaccttttttaattacttctaaaactctattctctgttcaagtctccgtgtttaatatttaatattgaaaccatagtgtttactgttttgctacctaatttctttttaaagactttattttttagagcacttttagtttcacagacaaaattgagaggcaggtacagagatttcctatgtacccccattctcacagattcatttcttttttaaaaatataaacttgaaaacttttctttttacaatcttaatataaattctcaaagcatttacaattgtccctgtcctttattagaaaattctcgcccaggctggagtgcagtggcatgatgatgactcattgaagccctgacctcaaaagcaatcctaccacttcagccacccaagtacctgggaccacaggcatgcaccaccatgcagagctattttttttatattttgtaggaaataaaagaaagaaagttctttcctatattgagttgaaatgttttcttatatttccaccaatagctcaatcccttgtggctacacagaacaaatcttaccctacacggcagcctttcaagaatttgaagacagttgtatttatcctcctacatcgtctctgctcttggcagtttttcatgagtcatggctttgaattctttatcatcctgtcttctgaatgtatcccaattagtttccatacccaaagttgactgtaggacccagttttagtctgaacatcacagcaaaaggaacaatgagagcacttggacacaagaaggggaacatcacacactggggcctgtggtggggtgaggggagtggagagggatagcattaggaggtgtacctaatgtaaatgacgagttaatgggtgcagcacaccaacatggcacaagtatacatatgtaacaaacctgcacgttgtgcacatgtaccctagaacttaaagtataataaaaaaatttcaaaaaaaaaaaaaggaaaaccaattttgttcttgagaataaatttccgttaacaccccttgctgcccacccacacatccccacaaacctgcctaatgagattagctttg

SEQ ID NO: 1916 - DNA, 2230 bp, Homo sapiens
actataagagacactttgtgtaaagataagagggtgtcctcaatgtctgttaaacactggggagcaactgactcaccagatcacagaaaccctagggcagggaaggagggtcaggcagcccacagccacccagcctcaccaactccacatttcggagcaggaggccagtcaccctgagtcagccacggggagacgctgcagctgtaagctgtgcaggcccggaagttcaagcctcagccgcaaacaggggaagccacacacagaaacacaacagcagcccccgcaggtggaggcgtgtgcccctgctcagaggacaacaaccttcccctgcccgcaccagccaacaccgtgccacctctgctgagaacaggactggggcttccagggcaacaggaagggtttggggtggtgatgggaagaacttcccagtcctgaaagtgtggttcctttccccgaagaagccactggagcacctaaggtcactggtactttgaatcccatccagggggcttgaggcagagtcatgatgaagaactgggggacgccagccccagacagccttaaagggagcttttcagggacctctggccagtgggggatgagcctccctggagggagggagggagagaggctttctcaggccacgtgttcccttctctttccagcactctgggggttaagtcagatccgggaaagggaaatcttttcccagcaactccgccccagtgactcaggccagagggagggagacctagggaggggagagggaactagcagcttccccagctcctcaagggtcatgagtcagcagaaaggcagaaggcaccagcctgcatgcaagtgggactccatctaatcccttcttcctatggccaagtccctccttcccatccccactcaacccccatccatcccctccccatgcaaagagccaggccacagacccttgtcccacttggcccacatgttccgggaaatgcctccctctccccattccatcccgaagggaagtctccctcgaccctggcttccgcccatcaggtctgtgccctcccttccctgagggccacttggctcctcctagcccctcagcggcctttagctgaggccccgccccagctcctcctcccagttcaacaagtctccaacagctaaacccattccgtgagctctcactccatcccccaacactccccagtcccagcaggaagcaagccaaggctgccctcccaccctgggttcaccgcattcccacagcctggctggttctgaccagttgtgctgggtttgggggcctccctggggtccccagacaatccttaggaaacaaggccagttctgagtctccacagaccctccccaagcccactggcaatacaggaaagcctccagagccctgaacacccacttccaggaacgagggagcaggcaagaagggatgccggatggaagaaccagccctgcttcctaggcttcccctggcccccagaatgctccaggtcagccctctctgatccctaggagccagggccctcagactccccaccactgggcaccactgctggcaccagctggccccagtaagcccagtcctcagcagttgcgtaaatgaagcaaaacaggagaaacaggaggtgagctctttaggcccagactccagcctggagcagaagggcaggaagctggggtgcctgtggagagacagttgagggggtggcccaacacccctccaactcccccacaatttccgccagaggaggctttaaagtgtgacttcctgtgctggggctgcagagtggggaggcgacgctgagatcggccttgtggtctgaccccgatccagccaccttgcagggacccaattagtcttcctttccccctcattcatgtgtctgttcatttaatgtcaaggtgttgggggaggtcgtggcagcttctcctccaagggcccagttgagatcccatctccctcccgtgaagccaccattgacgatgtctgtttcctccaccccggctccttagacccatagtccctgtgaactcgaagcacgtgaactgaccctatctacttttggctcttatcataatatggttatgttgggtgacagatatgatctccccaaagtgaccacgaaccttataagatgagagatcaaaaaatgtcttggtcagaaagtgtcttatcctcccctggtgtcctctcagctcccagaaccagacctccagactg

SEQ ID NO: 1917 - DNA, 2702 bp, Homo sapiens
ggcacatgttttcattttatatatacttaaaatctcctaatgtattattataactattgctatatttggttaaaaatttaggtttatccacgtttgcccttttcattgttctttatgccttcctgcatctttgagcttccatctgggagcggaatacacccttcagtgttgtctttaggttagactatcgatacaaattctctacatgaagtgaaaaatgttttttttctctacttcattattgaggagtaattttactggtagagaattttaggtttatagctatattccttcggcactttgaagataattccattttattctggcttctcttgattctttcaagaagtcagctgtcagtctgatacttgcacctttgatgttaatctgtcttttctctcaggtttcttttaatatgtcttctataacttttatttttagcattttttactatgttgtgcttttctttttccttatcttggtttaagtttggagatctacttgaatctgtgcttttggccaatttttgcaaagtctcagtcattatcttcttgaatatgcctctttcccattctctcttccctctcttctggataccttctatctatctaactttctggacatgcatgaatgggccccggcaacctatctgaccccatcccctgccgtactctcgttactcgcttgtctctatcttgctgtttttctaacatgccaagcatgcttcttactcctagatttttaaaaatattgcttccttagcctggaacactgttttcaagatatgtctaagactcattcccttacatgattcaggtctctgctcaaatgtggccttatcagagaggctttctctgacatttattcaaaattatcatccagacctctcctctcccatattgttctctaactctttacctggttttatgcttcttcatagcacttactacaatatgacacattatatatccaatatttatttgcttattctttgtctctctccatttgaatagaaattctgaagttctgtaagaggagagagctttttcccaccccctcctcacagttgtatcccatcccctggaatagtgcctggattagagtaaatgttcaataaatatttgtaggagaatgaatgaatgattaatagatagaagatataggaagagttctctacaggaagtaaagaaagtggagaaggcagaataacaaactaagtaagtcttttaatttgtatggtctatattttaatctttcgaatgtaaagatagtatcattgatcatatttctgttcatcaatgttacctaaaatagcaaaatgaaatattaatatgtttgaagatatagctttcattagtttaaattaactatctcatttagtttaggcatatggtccacaaatttttaagaacatttaattttaatttaaaaaattaagcctaccaaataagatgcattattttccagtgacttaatatgtatattcaagactttttcaattttttatagtataaaattattgtgattgcacatgaaaatttattatttaagcaaaatattatgagtgcttataagtacaaaggctaaaactgatatccctaccaaccacaaaaaaataggccaggcagctgggtactgcctagcctatttttttgtggttggcagagatatctctttattgtgtagatatttaaggactcatatagacccatcattttttatgggcaaaaatcccaactctggtcttctaaatgtcttttgtaaatttatttccctaaataaatcataaatccacttataatacctagacccacacaatgtgtattcgtcatagctgctcaaaaggaatccacagtgtaggtcagagctacttgatgagagaaagtcttgactctgctaataatgtttttacctcactggcacccacagtattttgccagattgcctgaagtcagcatgccttcctgatggtcatggactgttctgcttttccaggaatgtctcaaagggatcctgcctgaaaggaaagaggccatactgtgatatttcactgcttataaagagaccaagaatggcctctgtcttgttcttttagctagcttcaaacaaacttagccagcttaaaaacagaaatggaactgatgaagtcatcaacctagagcctcccgctactgcccatgtattttgtagtctagaatgaagctaataatctcaagaactgcttcctagaaaggttaaggagaaaagcatgccccatcccacttctcctcccatttcccactcttgaaatagcattgttagcatctgatgtgagccagaggagtatttgaggctgtgccatatgtccttgttagaaacactgagcttataatgactaagaaactccagggggttgtctaaaccaccaaggttataaagggcacagcatcatcacagctgaactaaaatttaatatgattcttactttaccacccatggtgacctaagaaggtggtaagggggacaaactctaaatagagggctcagttgtggctcaccaagaagctaaatatgctgttttcatggtagaatagggaagaagaaactggtaaatatttccaaatgtcatgtgtttacatatgaatctattcacttctttatttttaaaattcttctgagaagtactttagaagtaatccctaaatttaaagtatttataacaa

SEQ ID NO: 1918 - DNA, 4032 bp, Homo sapiens
accttgcttcaaactaagactcgaccctggtatattaaatatgacattaaagcgttcgttactttaaatagctacatttgttgatctaatgtgtgtcaggcagaatccaatgtgtttcacagattttctttaattctcctaaattttttccccacacctttgctgtatgaacatgaaatttcgcacaaacatggtactgttctataagaaatggtatggttctataacaaatacattaaaattatgtgctactaccaaaatatgtctcttaatgtcataatcttggtaatagtaagcttacatataagtgattttccaagcacttatatttgttatttctaacaaaattatcaaaagaagagcagagtgtgctttctgttacatatgctagctgatcaatgattttgttatttttaaactgtggatgtttatcacagggatgtgagttggaattagaaaaaaaaactttcaacaacaaagtatatattttatagaatagctgccctctcttacaatcaagtacatcaatgaactagactaccgaggttggtgaaatctcattacaacagtagctgaccaatagctggtcagatatactaacaatcaaatataaatggcaagtcccagccttcaagcttgagtacattctgttctttagatggccacatgagaacagagtaaacagatcagtgctgatctgcaccctgagattcacaggctgcaaacaaaatggagctcccccccaccaagagaatttaggcacctaagttttttaggtccaaatatatggtaccataactgcaatagcaatgccaatttacaaatacgtagcccatttaaaattcatttgctcattcagtcattaaaactaaattgcattatttaaaaactagactcaagaaattaaaatggcatgcccaaggtcacattgtgagtggcacaactaagacatgaactcgtgtcttttaactcttaactgatgttctttttactcttatagagtagaataaggtcccggacctttaagaaacaccaattctggagctccactgtagacttactaaatctaaacctctgaggttgggtcttgtagtaggcagaattctaaggtggcccccccaaattcctataccccagccaacagtgtgcacatcctgcataatccctccctttgagtgtgggcaggacctgtgaatatgatgaaatgtcatgcccatgattaggttacatatgtggcaaaggaagggggttttgcagatgcaattaaggtcttaatttagttgagttgagttgattacttgaaagggagagtatcctgtgtgggactgacttcagcaggtgagagctcttcaaattagggttgggtttcttctgaagctagagaatcttccgctggccttgaagaagcaaatggccaggcagtgagccgtctatgcagatgattacatgttaaagatctgagtgtggcctctaggagaaaagattggtttctagctgacatctaacaagaaaatgtggatctcaattagccacaaggaaattcaattttgccaccaacctgaacgaacttgaaagtgattcttcccaaattaagcctctaaacagcataaactttgacctcatggccaatagcactgtaattcatgcttgagcaaagacatagtttctaaccattttaaccggtcagatcaccaacaaaaagcacaaaactgtgaaatgtgtggcactaaacagacctcaaaaaagacatttgattgcagtatgaaagctgatataaaaaggcagatcactgccttgtttgattttagctgggaatatgtgcctttttaggcaactcaaattttttgctgctctgtttgaccacaaaagctcccaaaatattgatttttagggctacaaataaatcttagcaagtaagcaaatgtgaaaaaaaaatccatgaataatgaaggaccaactgtatattgaaatgttaaccgatgttgcatttatttactatatttcctgaatttttacactgaacatgtatttttttaaaaaaccctgcattttgaaaaaataataaatttctcaattcaaccacagcaaattctgcaccttctgcctaccttatgaatagttttattagctctgtattaaaactgtatgcttacttctgaatcctttaattgactgtcgactgatgtaagacagtacatggcacataagcagtggtaaaacagagatatagacaaatggaacagaacagagccctcaaaattaataccacacatctacaaccatctgatctttgacaaacctgataaaaataggaaatggggaaaggatttcctatttaataaatggtgctgagaaaactggctagccatatgtagaaagctgaaactggatcctttccttacacctatacaaaaattaattcgaaatagattagagacttaaatgttagacctaaaaccataaaaacccttgaagaaaacctaggcaataccattcaggacataggcatgggcaaggaattcatgactaaaacaccaaaagcaatggcaacaaaagacaaaattgacaaatgggatctaattaaactaaagagcttctgcgcaacaaaagaaactaccatcagagtgaacaggcaacctacagaatgggagaaaatttttgcaatctacccatctgacaaagggctaataccaagaatctacaaagaacttaaacaaatttacaagaaaaaaatcaaacaaccgcatcaaaaagtgggcaaaggatatgaacagacacttctcaaaagaagatatttatgcagccaaaagacacatgaaaaaaatgttcatcatcactggccatcagagaaatgcaaatcaaaaccataatgagataccatctcacgccagttagaatggcaatcatcaaaaagtcaggaaacaacaggtgctggagaggatgtggagaaataggaacacttttacactgttggtgggactgtaaacttgttcaatcattgtggaagacagtgtggcgattcctcaaggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccatcaatgatagactggattaagaaaatgtggcacacatacactatggaatactatgcagccataaaaaaggatgagttcatgtcctttatagggacatggataaagctaggaaccatcattctcagcaaactatcgcaaggacagaaaaccaaacaccgcatgttctcactcataggtgggaattgaacaatgagaacacttggacacagggtggggaacatcacacaccgaggactgttgtggggtggggggagtggggagggataacattaggaaaaatatctaacataaatgacgagttaatgggtgcagcacaccaacatggcacttgtatacatatgtaacaaacctgcacgttgtgcacatgtaccctagaacttaaaatataataataataataaaaagaggtggtagagaaatgttgaatgaatgggtgaactttatcaaatgttgagtttgctcaaactattcactccacaggacattcttcaacatgacaatagttaaaagtagaactacaaattgtgatgtgagtattctgtaaaacttcacacaaaaaattaccagttatcaccaaatcttctcagggaaggcaggtctcttgcaacggaaatgaacatttttaaaaaatacatatttaggaagtacaaatgcagtgttgttccacagacataaaataaatcttttcaatagggatcagcatgaaaagcatctgcactgctagaaccacgtacatcgaaaatttatcaaccaacatcctaaaatattttcaaagtaactgaatgcctataaaagaaggctctgtaccaatttattgcaacacaaagattatcagatagctagtattt

SEQ ID NO: 1919 - DNA, 10239 bp, Homo sapiens
ttatcataatcagtatatcagaagtcgacatacttctactacacctagggactctactcactaagtacaactgtctactctggaccttatatatataacaaacataagacgactctaaaggtggagagaagaaggcagactagctaaagacctcaagatccatgatgacatgctgggttttctttttgcttcttttatcccagatttgcagtggaaaaaaaagttagcaactcagaaatgtagacaaaaacaggcaaggaaacaaaaacaaacaaaataacaacagcaacaataacaaagccctaaaaaaaacatgctctctctagccaatggtctaggaaatggccagcctatgagaataaaaacatttagacactaacagttttacacaagccaaacaccacagaaaaaaaaaaaaaaaacacggtcctactacattcacaccagcacaggccaagtggggagcttaggcctccatcttgtcaagattgtgatgagtcatcccaacaccctaggtggtgtgagagaaagccaagtggggagctgggactttcattcccaccagttggtaaccagcacttccctagtacactgtgtactatcagtgggaccatatgaaaaaccaagactcccaactcctacccatcagtaatgagtcactctttcccctccccactggggtggtttcaaaggaggcagagtggagagttagaactttcaccattgcctggtaataaggttatcttttattggaggccatcctcaacatgatgtcagtgaagaccatgtggagagccaaaattcccactcccacccagcagtaatgagacactcctgtcttcaggagtaaatagaagccaaatgaggaacacaaacttttatctacacctggcagtaacaagggagctccttccccacatatctgctaaaatggtgtcagaaaaggccagttaaaacagaaggtttaaataaaatccagagtctcagaacatatgaaaaagtccagatataagtcaaaaatcactcgtcatatcaagaacctggaagatctcaaactaaatgaaaaaagacaattaatagatgccaacactaagatgacagatgttaaaatcatctgcacagattttaaagcaacaatgataaacaatgtttcaatcatcaattacaaacatacttgaaataaatgaaaacggagaaaaaacaaagaaatagaaaatataaggaaaattcaaataaagtattacaacagaaaaatatggtaacccagacacaaagctcatttggaaaggctcaacagcagaataaatggacagagaaaagaatcagtaaactggaaagcagaatagatgttatctaatctgaacaaaagaaagaaaatagactacataaaataaacagagcctcagaaacctggaaacaatatacttaaaaaaaaaatctgacactaatattcaggtaaagtttccatacttcattcaaactggtaaaatgacaacatcagtagttatgtacatataatacaatatgtagagtaaccaccagaaactacacaaggatatacctcacaaacgctattaataaatcaaaatagaattctaggccgggcgctgtggctcacgcctgtaatcccagcactttgggaggccgaggcgggtggatcacgaggtcaggagatcgagaccatcccggctaaaacggtgaaaccccgtctctactaaaaatacaaaaaaattagccgggcgtagtggcgggtgcctgtagtcccagctacttgggaggctgaggcaggagaatggcgtgaacccgggaggcggagcttgcagtgagccgagatcccgccactgcactccagcctgggcgacagagcgagactccgtctaaaaaaaaaaaagaaaaaagaattctaaaaatgtttgcataatctttaaaggcaggaaaaataaaacaaagaattaaaaaatagaggaggagaaaaaaacagaaaacaaaaataaagtaccaaacttaagccctaacatattaataattacattaaatataaataatgtaaatataacattaaaagacagagattgacagatgaaatttaaaagcataacaaaattacatgctgtctacaagaaactctcttcaacgaaatagggaagttgaaagtaaaagaatgcaatatatacataatgcacatatcattcaaagaaaatcataagtggctatactaatgttagataatgtagacttcagagcaaaaacatatatatattaacagaaagagatattatataattataaaatagtcaatacaggaagaagacacagcaatcttaaatacatatgcaccagacaacagagacgcaaaacatatgatacaaaaactgataaaattgaaagaagaaacaaacaaatccacaattacagttggagtctttaacatgacctttggaagaactaaacagctagacaaaaaattagcaagaatatagacgaactcaacaccatcaatctacaagatccagtcaatatttataaaatattctactgaagaataggaaactatatacagtttcaagagcccacagaacatataccaagagagaatatatcctcatctatgaaaaaaaaacaaaattaaaataactgaaatcagactaagtatgttctctgactataacagaatcaatctaaaaataacaggaatgtccccacttagaaagtaaacaatacattttaaataatccatgagtcaaagaggaagtctcataggaagtcaaaatacattcaaatgaataaaaatacaacatatcaaaatttgtgggacacagttaaagcagtacaaaaagagtaatttacagcatgcaatacatacattagaaaaaagaaaaatctcgaatcaataagctaagcccctacctgaagaaactatgaaaactagagcaaagtaaacccaaactaagtagaaagaagtaaataagtaaataataaagagctaaaatcaataaatcaaaaaagaaaaaatcaatagagaaaaccaataaaacaaagagctaggtctttgaaaagatcaataaaactgaaaaaatatctagcaagactgacaaagaagaaaggaggcatgagttgtcaatatcagaaatgaaatagattcattcaagatcctaaagataacaaaagaataatgatagaatgcaatgaaaaattccatcaatataaatttaacaacttagacaaaataaactacttccccaaaaaacataaactaccacaactcatctaacatgaaatagataatttaaacatccttgtaaccaataaggtaattaaatgtacaacttaaaaaatcccaaaaaaggaatgtccaggcccagatgggttcaatggagaattctaccaaatggttgaagaagaattaacatcaactctatacaatttcttccagaaaacagaagaagaaaaacttaccaattaatttacgaagctaaaattacactaatccccaaactagacaaagacaaagggagggaaggaagaagggagggtgatgaaagaaagagaaggaaaattacacatcaacattcctcataaatattcatgcaaaaaatcattaacaaaatattgcaaacaaaattcaaaaacatagcaataatataatgatataaaaagaatcatacaacatggcctaatggggtttatttcagggaagcaaggctagttcaactttcaagaatcaatcaatgtaagctaaaacattaacaggatttatttaaaatcacatatcaaatgatgcagaaaatacgtatcaaatgatgcagaaaaaatcatttgacagaattcaatattcatttgtaataaaaaatgctcagaaaaataggagtagaagggaacttcctcaacttgacaaaaagcatcttcaaaaaacctatagataacattatatttaagtggtaaaagactcaagactttcaccctgaaattgggagcaaagcagagatgtctactctcagcacttttactcaatatagattgaactcagctctgtaccaagcggacctaatagacatttacagaacactccaccccaaatcaacagaatatgcattcttctcagcaccacaccacacctactccaaaactgaccacacagttggaagtaaagctctcatcagcaaatgtaaaagaacagaaattataacaaactgtctctcagaccacagtgcaatcaaactagaactcaggattaagaaactcactcaaaagcgctcaactacatggaaactgaacaacctgctcctgaatgactactgggtacgtaacgaaatgaaggcagaaataaagatgttctttgaaaccaacgagaaaaaagacacaacataccagaatctctgggacacactcaaagcagtgtgtagagggaaatttatagcactaaatgcccacaagagaaagcaggaaagatccaaaattgacaccctaacatcacaattaaaagatctagaaaagcaagagcaaacacattcaaaatctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagtgagaagaatcaaatagacgcaataaaaaatgataaaggggatatcaccaccgatcccaccgaaatacaaactaccatcagagaatactacaaacacctctatgcaaataaactagaaaacctagaagaaatggataaattcttcgacacatacaccctcccaagactaaaccaggaagaagttgaatctctgaatagacaaataacaagatctgaaattgtggcaataatcaatagcttaccaaccaaaaagagtccaggaccagatggtttcacagccaaattctaccagaggtacaaggaggaactggtaccattctttctgaaactattccaatcaacagaaaaagagggaatcttctctaactcattttatgaggccagcttcattctgataccaaagctgggcagagacacaactaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacagagtgttggaagttctggccagggcaattaggcaggagaaggaaataaagggtattcaattaggaaaagaggaagtcaaattgtccctgtttgcagttgacatgattctatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatcctacttacaagggacgtgaaggacctcctcaaggagaactacaaaccactgctcaacgaaataaaagaggatacaaacaaatggaagaacattccatgctcatggctaggaagaatcaatatcctgagaatggccatactgcccagggtaatttatagattcaatgccatacccatcaagctaccaatgactttcttcacagaattggaaaaaactactttaaagttcatagggaaccaaaaaagagcccgcattgccaagtcaatcctaagccaaaagaacaaagctggaggcatcacactacctgacttcaaactatactacaaggctacagtcaccaaaacagcatggtactggtaccaaaacagagatatagaacaatggaacagaaaagagccctcagaaataatgccacatatctacaactatctgatctttgacaaacctgacaaaaacaagcaatggggaaaggattccctatttaataaatggtgctgggaaaactggctagccatatgtagaaagctgaaactggatcctttccttacaccttatataaaagttaactcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattaacaaatgggatctcattaaactaaagagcttctgcacagcaaaagaaactaccatcagagtgaacaggcagcctgcaaaatgggagaaaattttcgcaacctactcatctgacaaagggctaatatccagaatctacaatgaactcaaacaaatttacaagaaacaaacaaacaaccccatcaaagagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggactgtaaacgagttcaaccattgtggaagtcagtgtggcgattcctcagggatctagaactagaaatatcatttgacccagccatcccattactgggtatatacccaaaggactataaatcatgctgctataaagacacatgcacacgtatgtttattgtggcactattcacaatagcaaagacttggaaccaacccaaacgtccaacaatgatagactagattaagaaaacgtggcacatatacaccatggaatactatgcagccataaaaaaggatgagttcatgtcctttgtagggacatggatgaaattggaaatcatccttctcagtaaactatcgcaaggacaaaaaaccaaacaccacatgttctcaatcatagatgggaattgaacaatgagaacacatggacacaggaaggggaacataacactctggggactgttgtggggtcgggggacgggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaataaaaaataaaaaaagagaaacaagaggaaataaaaggcatgtatactggaaaaaaaaaaaactacccctatttccagatgatatgatagtctacatagaaaatctcaaggaactcattaaaaagctcatagaaacaataagtgaatttagcaaggtagcatggtacaaaataaacctgcaaaaataaattgtattttaatatcaataatgaatatatgggaagaatttaaaatgcagtactatttacaaccatgaaaacatacttaaatataggtgaaactctaacaaaaacatgtataaaacctgtatgctgaaacttacacaatattggtgaaagaaatcaaagacctaaataaagggaaagacatactgtcatgataaattgaaacactcaagatagtaaagatttcagtttttcccaaacttgtgaacaagcttgatgaaattcctatcaaaactcaagcaatatttttcatagatatagacaagattattttcaaattgatacagaaaggtggaagaactagaagagttaagacaattttgaaaaataataaagcaggaataatcagtatacctaatttcaagacttttacagctacaggaatccagattgtgtcatattggtgaagggataaatacatagcccaatggaacaaagtaaagaatccagaaacatatccacaccaatatgcccaacttacttctgacaaagttgcaaaggcaattcaataaaagaaagagagcttttcagcaaatggtgctagagcaattgactctccatagacaaaagaatagccttggacctaaattttatatctgaagcaaaaatcaaatcaaaattgaccacagatttaaatgtaagtcataaaatcataagacttttagaaaaaaacataggagaaaaatcttcaggatctagagctaggcaaagagttcttatgacatgaaccataaaaactgattaattggactccatcaaaattaaaaattttctctgcaaaaggccacattaagaagatgaaaagacaagtcaaaaagtggtagaaaatatttgcaaatgacatatctgacaaaggaaaattttctagaatagattagctcaaaatgtaaatttaaaaaattcaattagaaaatgaaaaagccatgaacagacatttcacatatttagagaatacataaatggaaaataagcacatgaaaagataattaaccattatgaaaatccaaattaaaagaacagtgagctatgactacacactatcataaaggcaaaaacatagtgacatcaccaaatgctggtaagaatgtgaagaaactggaacattcatacgttgctggtgggaatgtaaaatgttacaaccactctgcattaacagttcgtcaactttttaaaaaactaatcactcaattatcatacaatccagaaatttcactctagggcatttttaccagaaaaactaagggttatgttcatttaaaaaaaaacctgtacacaaagtttatagcacctttggtcacaacagccaaaaattggaaacaacctgatgtctttcaatggacgaattattaaataaagtatgatacatccattccttggaatagtacacatcaataaaaaaaatgaacaaactattgatgcatacaacaacctgagtgaatctccagaaaattatgcagagcaaaaaaaaaagtcaagtcctaaaaggttacatactatatagtaccatttacatactgttctggaaatgacaaaaatggaaatgaagaacagattcacagttttcagagcttaaggaagaagtggggtgggagaaaagtggtcatggctataaaagggcaatatgagaaagccttttagtcatgtaacacatctgtatattaactgtatcaatgtcaatattctattggtaatatcatactgtagttgaggatgttattgagggaaacagaaaagagtacactgaatctatcatttcttataactgcaacagaatctataactatctcaaaaaggtttaatttaaaaaaaatgtagatcatgatttagtaagtaaagcctgagattctgtatttctaacaagtcttcagataatacagattccactgctgtggggaccacaatgtaagtaataagtcattggaaaattggtcactgtaactcatcatactaacaggctaaaaataaaaaaacccatgaccatctcaatagatgctagaaaggcatttaacaagatttaacatctataaaagagaataactatcagcaaactaaaattagaaggccagttccccaacctgaaagtgtgctaatgaaaaacttacagctaacgtcctatcaaccattattgactgaatgcaattttcctaagattaggattaagacagagatttctactctcatcttttttttcaacatttcatttctagagatcctaaccaatgtaatgaggcaagaaaaaaaaggcgtacatattggaagggaagaaataaaactctctttcccagaaaatatgacagtttatgtagaaaattatgagagctaccaaaaacctactaaaactacaaagccacaggatgcaagggaatatacaaattgtacttccaaaattggtgaatttcattttgtctaagttataccccaataaatctgattttaaaagctctatagctaaa

SEQ ID NO: 1920 - DNA, 3350 bp, Homo sapiens
cccgcaatgcttttgcagtctgcataggatgttagaataacagcatgcagatgaccgcgccatgtcttatcaggaaagcgtactgatgtggaggccaagaagctgctggctgagatttcagaactgggtttctaacctgccgtgggccttggacagcggctgccattcttctgtgcctccctttctccatttcacgaggccccgctatccctctacctccccaggaggtcccagcacaggcactgctcaggaagcaccaccgtgaggtgcgaagggtgtgaaggtacgaaagacaggagggcaccacaggctggcggcaccactcccctcgcaggccagccagaagccaggcagcagtgtggaggctcatcctgcctctctggctggtgcccgaccccagctcttgagccccccaagtcaccgcaacgcccaggccttgtgtttttgccgaagctcgtgcctcagagcctggctccgacgctttcctcctagaagcctcccctgatgcgtcccaggaaccctggcctctccccttgtcctcaccccatgcatcgagcgctccctggactccacccctgcgtgggtctcattcctctttgtgtcctgagggcttggctctaggccgcccagtagaggccggctggatgaatgctgatgggacggtctcatctctgtccacaaaacccctcccccacagccataccctcactgccatgtgactgtgttgacagaagtctgctggcctcagaggtctgcggcccaggaaatctcagctgccatcagtgataaacatgacctccctgtgggcgtcacctccacccctgtgctggatgggccttctcatcgatttcagtgatcatgaagttaatcagcagtcagcactcaaacacgtgcagaatcaatgacaactgaaatgattagaatccgcataaggagggcattctcatgaggtatctggggcttttgaatgttcttggatgaaaccagaaatgaaaggctgctaaaatgaaagcctgaaagccttctagctttttttttttggtatatatatatatatatattttaagtggagacgggatttcaccgtgttagccaggatggttttgatctcctgacctcgtgatccgcccacttcggactcccaaagtgctgggattacaggcgtgagccaccgtgcccggccaagccttctagctttcaagacagaaagggggaacctgaagatgatggtgtgtgtgtgtgtgcacacgcgcgtctgtgtgtgtggtgggggttagagggagggtggtcttggggaagtgagctttggcaggtgcggcctgtggaggcagccggggactggatgactgggaatctctcccgtggaggggacagcctgaagctcgcgggtgtgagctgagaataccagctcaggtgggaagggtggtggtggtgtccacatgggccagctgcgctggtggaggctgcagggcaccaggtcaccccctgcaggcagccccagctcagcccaaccctccaggtcagggccctcggggacagtggtgtgcttaaagctctgctgcccgaggaagtgggaagccggtaagaggcgtgcaccgtgcgctggcagtctcccgacactgacagaatgtcatgatccagccaacgaagaggtttaagaatgaagccaggtcacctttccactccccagtgctaagtaaggaggaatctgtcattactgagtacactgatacttacaaccaggcttcttccatttatccaattccctgcagtaagaatggcggcgacagtactttcttcaccaagctttatccacacgataaatacgctgacaatgacacgttttcattttctaacactgaagactatccagggttggccaaagtgtcagtgctctcacttacaatgccagagctgtgatttttgggggcaagattcttttaccttaaaaggcattatccaacctcaataaagcagcaggctaggcgaacatcaacagctactaacatcacaaaaagagatggacgtccacacgtgcctcctcactggtgaaatgctccagcaaaacacaacagtcaaacaagcaaaacagcaacagactctgagcagggcctgaggtctaactaccaatttacagaaatacaggagacacgggggaacgcagaaaggacaccaacagcaaaatccagatgggggacaccctccaggacaaatgactggttcttctacaaagagactgctaaggacaagaggcagaggggggacctgtagctagaaaaggcctcacgagccctatccaccaattataatgtatggagctgatttggatccagattcaaacaactacactgtaaaccatttttctttttttatgagacagggtctctgtcatccaggctggcatgcagtggtatgatcacagttcacagcagcctcgaacttctgggttcaggctatcctcccaccacagcctcctgaacagctgggactacagacatgtgccaccgtacctggctaattttttatattttttgtctacatagggttttgctatgttgccagtttggtctaaaactcctgggctcaagtgatcctcctgccttggcctcccaaagtgttggaattacacagacatgagccattgcacctggcttcaaagacattttgaatgaagtttcaaaagctagcattcctaaaccaaatcatgccaatgcagtctacaatgaggcaggtctacgttcccagactcctcaaggctcacgcgtaggtctggggcaggcacatcttagaagcacatccgtttcatatcatcaagacactccacacctgggcaccactcacagctgaactaaggccccggacacaaggtataggggcctggctccttcgccccaaagcaagacagctcctggagcgaggggtgcagacaccaccacccagcctcctccccttcacccacaggtctcacaccagggcgcactaacctcagccaacccagcccgggagtgatgtccagccgcgctgctccccaccacgccatcacctcaccttgtgttattctctgcatggcttctagtgtcagtgtttttgtttattttttattgtctgcttcctatcactagaacagaagttctgaagaggcaggcagagtccggccttgttctcctctagctggagagcccacaccagggcctctgtgcggtggcgggaatggatgaactggttccgggagcccaggacctccatgctgggcccccagaggcacgttagggttatctttcagggttatcgttaaccctaaacgccgtgcctagaaggtttagggttaaagataacatccacagtgcctg

SEQ ID NO: 1921 - DNA, 1802 bp, Homo sapiens
ccccatattggcatacttaactctttttagtggtataatatacaaaagtttaccaagggtaacattagtacattcacaatattgtgcaaccatcaccactacccagttcacaatcatcttcgttaccttaagagatgccgttaggcggggcatggtggctcacgcttgtaatcccagcactttgggaggccgaggcgggtggatcacgaggtcaggagatcgagaccacggtgaaaacccgtctctactaaaaatacaaaaaaaattagccgggcgcggtggcgggcgcctgtggtcccagctactcagaaggctgaggcaggagaatggcgtgaacctgggaggcggagcttgcagtgagccgagattgcgccactgcactccagcctgggccacagagcaagactccgtcttaaaaaaaaaaaaaaaaaaagacatgccgttaagcagccattccccattcccctttctcgcatgaagcctcaaaatctgccttctcccttgaagcctcaaaatctgctttctatgtggatttgctgatgctgggcatttcatataaacaaaatcatacaataaatagcctttttatctggcttctttgacgtggcacataaccaaggttcacccgtattgcagcatatagcggtacttcattctttttcgtgggtaaataatattccattttgtttttccacttatcagcaggtggacatctgggctgcctccaccttttggctattgtgagttgtgctgctctgaacatttgtggtcaagactatgtgtgggtcaggtgtggtggctcatgcctttaatcccagcactttgggaggctgaggtgggcggatcacctgaggtcaggagtgtgagaccagcctgaccaacatggagaaacaccgtctctactaaaaatacaaaattagctgagtgtggtagcgcatgcctataattccagctacttgggaggctgaggcaggagaatcgcttgaacccaggaggcagaggttgaggtgaggtgagactgtaccattgcactccagcctggccaacagagcaagactctgtctttaaaaaaaaaaaaaaaaaaagactttgtgtgggcatatgtttcatttcccttgggttggtgtctagaatggaatccttggtcatacggtaattctatgcttgagttttaaggaactggcagacagctccaatgtggctgctccattttacatgcccaccagcaatggtcaagggttccaatttctctgcatctttgccaacacttgttattgtctgactttttaattgtggccactctattgggtgtgctgtagctatcttgtggtttggatttgtgtttccctaatggctaatgatgttgcgcatcttttcatgtgcttgttggcactcttacttttaacagttttgttaagtcactcggaagaggaaagagtacatagggaagtgcatttactcccaagttgctaaagaccaaaaaacttctagaaccccacctgcactaacgaagactctaaccccccaccagaactgtctaccctccaccgtggcaccatggtgtgcccgggaatgcggctggcgtggccaggcctcactcgcttcatgattctagccgcatccatctttgagtatccctctcttcagcctgtcacgggagctacgccctttgctgctacctgtgcgtgtgaccgcagcagctctttcttggcatgctctcaaccccactccccaatttgggtgtcataacctagtgttttcgttcctgacccttcactgcaggcccagcatggtgctgtgaa

SEQ ID NO: 1922 - DNA, 4697 bp, Homo sapiens
ccaaaataaggatttgaaagatttagatcatgatctgtaatcaaactttaaacactggtgaatagtacatccgttccttcttttgtattctgggtttttgccttcactccatgaaaggtatcacaaactagtagtcggctaactacacatgccttggcctacagatgtgtcttctttgactttcagtgttaaaaatacttagattcaattagatgccaatgtttcacataaaagtctcaatttcagtttcacttgaagaatggaaaatcctcccagcaccatgcccacattcctgcagggagacagttcaccagggcagagatgcagctgctccctttagacagggcatgtggtctcagatttaccaccaacccaagctgccctgcttcacctgctgacattccctgcgcgtctgtaggcattggagtttgctaccattgctagagcttcttggtccatttataatcactaaaaggtaaagtttcactcttaattcagtcaggagctttttcctcaactattaatagattctctttctcttttctccttgatatctccatgatatcacataaaattttagaattagaagggaccttagaaattatttcatcttgaaactaggtcttaaatatatatatatggtttttcttattattgtggtaaaatatataacaaaatttaccatttaccactttttaatttgagaaatcttttttatggcaataaaacctatataacaaaacttaccactttaaccatttttaagtgtacagttccgtggcattaagtacattcacagtgttgtgcaaccattattaccctccatctccaaaactctttatcttgcaaaaccgaaactcagtagccattaaacaatgactcccatttctctcctcctccagtccctagaaaccaccattctactttctgtatctatgtatttgactattctagatacatcagataagtgtgtacaatatctgtccttttgtgtctcacttatgtaacttagcatgatgttttcaaagtgcatccatgttgtaatatgtatctgaatttcattcctttttatggctgaataatattccattgtgtgtatataccacattttgtttattcattcacctgttgatggccacttgggttgtttctacattttcgctgttgtaagtaatgctgctatgaatgtaagtgtacaaatatctttctagtccctgctttccattactttgggcacataactagaagtgggattactgtaccatacagtaattttatgtttaattttttgaggaactgctgtaaagttttctacagcaggtgtatcattttacattctcaccagcaatgcataagggttccagtttctccacatccccaataatgcttgttgctattttctatttttctgataatagccatcctaaagaatgtgaagtggtatctcatggttttgatttgcatttccttaatgacaaatgatgttgagtgtcttttaatatgcttattagccattttatatcttctctagaggagtatctattcaagccctttgccctttttgaatcaggctgttttgtcgttgagttgtaggagttcttcatgtattctggatattcattccttatcaggtatatgatttgcaaattttttttctgttctgtaggtcatcttttcactttttttttatcatatcctctgatgtacaaaagttcttaatttcaatgaagtccaatttatctgtttttcttttgtcctctgtgtttttggtgttatatctaggaaatcatttacaaatccagtgtcatggagatttcccctatgttttcttctaagaaatttctagttttagctcataaatttaggtatttgatcaattttgagttaatttttatgtaaggtattaggtaagggtccaacttcattcttttgcacgtgcatattcagttttcccaacaccatttattgaaaagactgtcctttctccccttgaatggtaccctttgcacccttgtcaaaagtcaaatgaccatatatatgaggatttttgtttctgggatttacattctcttttgttggtttgcctgtccttatgattactgtggctttgtaataagttggggtttttttgttttgtttgtttgtttgtttggtttgtttgttttgagatagagtctcactctgttgcccaggctggagtgcagtggcacgatctcagctcaccgcaacctccacctcctgggttcaagcgattctcctgcttcagcctcctgtgtagctgggattacaggcacatgctaccacacccgctaatttttgtatttttagtagagacggggtttcatcattttggtcaggctagtcttgaactcctgaccttgtgatccacctgcttcggcctcccaaagtgctgggatgataggcttcagccaccacacccagccttgtaataagttttaaaatcaagaaatgtgagtcatccaactttgttcttcttcaaggttgttttgggtattcttggtccttttaaagatattttatgaatggttttttctattaaaaaataccattggaataccattggaattttgataggattgcagtgaatctatagatcactttcggtggtagtatcaccttgacaatattaagtcatttaatctatgaacataggatgtgtttccatttatttaggtcatcttcagtttctttcagcaattttttttttaagagaaagtgtcttgctctgttgccctggctggagtgcagtggcacaatcatagctaattgtagccttgaactcctgggctcaagcaatcctcccacctctgccatcaagcccagctaattttttatttcttttagagatgaggtctcactctgttgcccagactggtctcaaactcctggcctcaagcaatcttcctgcctctgccttccaaagcagaggggttgcaggcatgagctaccacgcccagcctctttcagcgatgttttgtagttttcaagtatacaagtctgtcacctccttggttaaatttattcctaagtattttattcttttcatgctattgtaaatggaattgtttttcttagtttccttttcatatttttcattgttaatttataaaaatataattgattattattattattatttttttgagacaaagtctcactctgtcgcccaggctagagtgtagtggcgtgatctcggttcactgcaacctccgccacccgggttcgagcaattcacctgcttcagcctcccaaatagctgagattacagggacatgccaccaccccagcatgtaattgatttttgtatcttgattttgtatgctgcatctttgctgaattcatttattaggtctaacagttgtgtgtgtgtgtgtgtgtgtgtgtaaaatctttagggctttctgcatataagatcatatcatctgtgaacagaggttattttatttctttctttctaatttggatgccttgtgggttttttttttttttttttttttttgtttgtttgttttttccttaattgctctggctagaacttcctgtactatgatgaatagaagtagtgaaagcaggcatctttgtctttttcctgatcttaggggaaaagtttttcagtacagcaggtcctcaaataacataattgcattataacattgatgaggaaaaaaaaaattgattcccagctggggccactgtgtgaaatttgcacattctccccatgtctgcatggattttctctgggtactccagttttctaccacagatgtatgtgttgggttcattggtgtgactaaatggtcccagtgtgagtgaatgttggtgtgtgtgtgtgctccccgagatggaatgagatgtcctgtacagggctatccaccttgtgtcccaggcttccaggataggctctggccacctgcaaccctaagctagaataagcaggttggaaaatgaatgaatacaaattattattgaatacaaattattatcaaatacaaatttataaagtagatgataatcatacaactgcacaacaataagcgatgaggtatgaaagcgttcagctagcccaccatatttgtgattgttttttaattcatggtcggaggaggtgctccttaaatttttctatttgcaaatatctattcccttatttaatccaccaccactacaactgtcgtcattcagcgattcaccaaaaattgggtaatcttacttgttgttattaacctttcttaaatgtatgtatagcccacatttatttcaatgtttaatattagaggtgtgtagggtctttatttagaagttgggtgattatttgtgaccagaaacatgccataggaacttaactcttgtttatgtcgattagcctatgatgaaattggttttattataccttgtttcacttaaagtcagtttccaagaacctattgatgaggttgaggacttttatttggttttaaggtaaaagtgtgccaaaaaattgagattcatacagataagtagcttcaaatactaatagatttgtttttaacattttgactgatctttttttagctttactaatgttcagaaagggagtaatagtaaatttgtgtttcaaagctgagttgctcacattcctaattaatgagtaatcactctggagaaatcaacaaattttctcagctagtttaaaaatt

SEQ ID NO: 1923 - DNA, 781 bp, Homo sapiens
ctatttaattaaatgtggattctcactctcttgaccccagggattctgattttgcttctgtgggtttagggtacaggtgattcatgatcatatgttgagatgcattgagatatactacattgcttttagggtttcacatctgtatagggaggcatagggataaaattcattgaacgtttttttaactgtgtactgtgtgccagtccccttgatatgtataagcaagtgagatggagtccctaccctcaagacttggtctaatgggaccttggaaccctgccttgactctgtcagactacctcacttgagcaagccacttactctttaagccttagtttctctatctgtaaaatggagatagtcaattacttacttcagagcaaaaggcctgatctatgatcctgtgattcccaaggctcttttaagttgtgaagtcacagggtggactaacttccaatgctgagaacaatgatggggtggtgatgggtcagatagacaaataaatcaataattcaaccaccaataaatagtggaatatgtaaaagcatgcgctttggaatctggcagatccatgattcaaagctcgaatgtgcttgcctcttgctagttacgtaactgggcaaattacttcactgccctgtgtctgcaagtaaaatgaggacagtacttaccctataggactgctgcgagacattcaatgagagtaatgatgcacagcactcagtacagcagcttaaaaacaggtaacaccatgaagcactacagaagcagtgatcaataa

SEQ ID NO: 1924 - DNA, 2846 bp, Homo sapiens
accacatttttttcaaaagtgcctttgttcaaatactcatttagtgctgacactactccatggaatgtgggaggaaaatgcactctctagcactgagagatttaaaacagaaagtgtggttggctgggcatggtggctcacgcctgtaatccccgcactttgggaggctgaggtgggcggatcacttgaggtcaggagtttgagaccagcctggctaacatggtgaaacccgcatctctactaaaaatacaaaaattagctgggtgttgtggtgggtgcctgtaatcccagctactcgggaggctgaggcaggggaatcctttgaacccgggaggtggagtttgcagtgagccaagatcgcgccattacactccagcctgggcaacaagagccaaactccaaaaaaaaaaaaagaagaaggaaggaaggagttgttttaaaaaaaaaaaaacttcactgctaacctttaaataatacattaatcagaacaaaatgttacgaaaattaaaatgctgagtgcggtagagagtatagcacagttacaggtatatggatctgtctccttagtgtaattcaagaggtcgtaaacacagcacttagtgtttcaccatcacttctgtttggccccaaattcctaccattataattattttagacttaaaaatccataaagatgctgctccagtgtgtaacgtaagagaggaaatgtgatggtgtatctggggctttccatttaccacattaacaaatgatatcaagcaggacaggtatctcccacttaagcagtaatctgcttcagaaaaacctgatgttctgagtgaaaattctgatagcctattatttattaagtggaagaaaatagagcgtttttatatcaacctaaacccctcacaaccagcttttaaccacctaaagaaaacagtaaaatagacactcaccaaatgccaaggtgcgtggacaaatgttataaaccatatattaaggtgtaaagggctacaagcatcacttcctgctcatacaatgaataagatgttaacatacagtgtcgtaggccctacttggcctttcgctgtcagcagaaaacatgcacatctccttagttggcacctgcactacatttcaaggcatctccacatgattctgatgttctactaactgtaatgtaaatcacatgttattttgttaaaaacattgagattggaagatgtaaatgtaagtaggtgccttataagcatcagcaaaaagcaaaacaagaaacaaaaacatcttagtgagagctcagtctagcctgtggagattggatttcaaaaatcaggaggcaatccactgggcaaccattcactggaaaaatattcttcaggttatgtctgaattttattcggtagctaaactagctaaactacactctaggtaggtgttacaagctgtagggcaagcaaaataaatgacgttgctgactttaaaagacttgaaaataatggtactatgagagcccagtagagcattaatatggcttttttagttataataagtacatgccaactggacagactgctttgatttaactggacaaatgacagacaaataaattttggctaagattattgagatgccatggagctgagaaacatgatgcagccacctaaaagttagataacataaacacaagaattccagaccaaatctctcactctatgtaagatttggtgaagtcatttaatctttcttagtttcagctatgtactgtaaagattagatgagttaatgttgtaagcttttaaacaaatgacaggacacacaagggaacaccaagtatttttgtagatacagcaggtcctcgaataatgtcattttgttcgatattgttttgttataacgctgatgagaaaaaatgaaaatcaattcccggccagagcactgtctgtgtggagtttgcatgttctccccatgtctggataggtttcctctgggcactccagcttcctccagcatcccaaagatatgtacattaggtaaactggcatgtctcaattgccccatgacaagtaggtgtgggtatgggcatgagtgcactcagtgatgtgatgatgtcctgtccagggtaggttcccatcttgcaccctaagcttctgggagaggttccggtcacccaacactctgaactgggataattaggtaaataattatcttacttgttcatattaatctttcttaaatgtacgtatagctcacatttatttcagtgtttaataacagaagtttttggtgtttacgtaaaagcttagtgatatttttgtgaccaagaatatgccatagacacttcacatttgcttatatcaattagtcagtgggaaaattggtttgttatatggcgtgtcatttaaagtcacagtttccaaaaacccatcaatgatgttaagtgagaacttactgtatacacagctgggtttgaattctttgccagctgtgtaagcttgggcaaattattgaacttctccaggctttcattctcccatgtgcacagtgaaaacaactatatgtactttgcagaacagaaatagtgttagaaatatatggaaagtgcctagcaaagcatctggaccatagcagacagtcagtaaatgctactgattaatttgccccttactagtaaaactccgaaaactttcactcttctccatctaagtaaccagctcattgactcatgcctctaccttgtttttacccagaacacttaacttcttaaatttctgtcccttaccacaacttcttgtttctccactgttccttacaaacttacactttatccacataaaaatgtctactacttacttgaactcttattt

SEQ ID NO: 1925 - DNA, 1740 bp, Homo sapiens
cctgcactacatttcaaggcatctccacatgattctgatgttctactaactgtaatgtaaatcacatgttattttgttaaaaacattgagattggaagatgtaaatgtaagtaggtgccttataagcatcagcaaaaagcaaaacaagaaacaaaaacatcttagtgagagctcagtctagcctgtggagattggatttcaaaaatcaggaggcaatccactgggcaaccattcactggaaaaatattcttcaggttatgtctgaattttattcggtagctaaactagctaaactacactctaggtaggtgttacaagctgtagggcaagcaaaataaatgacgttgctgactttaaaagacttgaaaataatggtactatgagagcccagtagagcattaatatggcttttttagttataataagtacatgccaactggacagactgctttgatttaactggacaaatgacagacaaataaattttggctaagattattgagatgccatggagctgagaaacatgatgcagccacctaaaagttagataacataaacacaagaattccagaccaaatctctcactctatgtaagatttggtgaagtcatttaatctttcttagtttcagctatgtactgtaaagattagatgagttaatgttgtaagcttttaaacaaatgacaggacacacaagggaacaccaagtatttttgtagatacagcaggtcctcgaataatgtcattttgttcgatattgttttgttataacgctgatgagaaaaaatgaaaatcaattcccggccagagcactgtctgtgtggagtttgcatgttctccccatgtctggataggtttcctctgggcactccagcttcctccagcatcccaaagatatgtacattaggtaaactggcatgtctcaattgccccatgacaagtaggtgtgggtatgggcatgagtgcactcagtgatgtgatgatgtcctgtccagggtaggttcccatcttgcaccctaagcttctgggagaggttccggtcacccaacactctgaactgggataattaggtaaataattatcttacttgttcatattaatctttcttaaatgtacgtatagctcacatttatttcagtgtttaataacagaagtttttggtgtttacgtaaaagcttagtgatatttttgtgaccaagaatatgccatagacacttcacatttgcttatatcaattagtcagtgggaaaattggtttgttatatggcgtgtcatttaaagtcacagtttccaaaaacccatcaatgatgttaagtgagaacttactgtatacacagctgggtttgaattctttgccagctgtgtaagcttgggcaaattattgaacttctccaggctttcattctcccatgtgcacagtgaaaacaactatatgtactttgcagaacagaaatagtgttagaaatatatggaaagtgcctagcaaagcatctggaccatagcagacagtcagtaaatgctactgattaatttgccccttactagtaaaactccgaaaactttcactcttctccatctaagtaaccagctcattgactcatgcctctaccttgtttttacccagaacacttaacttcttaaatttctgtcccttaccacaacttcttgtttctccactgttccttacaaacttacactttatccacataaaaatgtctactacttacttgaactcttattt

SEQ ID NO: 1926 - DNA, 8822 bp, Homo sapiens
tgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaaccccaccatgctgccattggtatatgcaagggtgtgggcctggggtgcactgctaggaggggtcagaagaaagtgagaactgcagtttgttgttgttgttgttgttttgttgttgttgttgttttttgacagagtcttgctcttgttgcccaggctggagtgcagtgaggcaatcttggctcactgcaacctctgcctcccgggttcaagggattctcctgcctcagcctccagagtagctgggattacaggcgtacaccaccatgcccatctaatttttgtatttttagtagtgacagggtttcaccatgttggccaggctggtctcaaactcctgacctcaagtgatccgcccacctcagcctcccaaagtgctgggattacaggcgtgagccaccatgcctggcctgcagtttgttttcaatgcaagtgtgggatcaggttttgagagtgtggtgaggatcaagggaggcacttggcaggaggaggcagattcaacttccctggggatcagggttagggttggttaagattacagtggtgggttagggttggggttgggtagaggaggttctgggaggctgtgtgagtttggggcacagagctcctcttaagatgccccaataatcattcgctctgctgttaaaatgttaggatattgctagctacatgctgataaggacaaaggggacatccttaagagaaacctggcaccataagtacagattagggcagagaaggacattcgaaagagataggcaggcacagtaggtacagacatgaccactgtaggaccttcctggagtggcaggaaggagcccagccccagcagtggaatcacactgatcactgcacatatgtgtcagccaacagtgagggggtcccacaagcctgggtggggcaagtcagggatctaaggaaggagcaggaaaaccagacaaagaaaagaggtggagacttgaggaatgtgaagaagtccaacataaaactccctgctcaggaccctggggctgtgttcctgcagatcagccccacttctcccttgaggcatacttattttttctacaataagctctttacactatatttcttttcaatgaagttatctgccatctttgtactgcctcttggtgagaatctttctttcaagttagacaagaactgggacatcaggtctccccagtattagctccatttcagtttgaatttgcagaattgatagtgctgaacaacctgcactccaactttaagtggtgtaggaagaggccagcagggtcagaccctgaaaacagaccagccacgtctcccaggtggacgcagcgggttctccacgagcgtgacttggggatttacggcactgagaccgtgctacccacccccccttaaaaatccctcgtggctcccagttgccctgaaggggaatcccaaactcttcagaggcagcacatgctggtgggtgagagttgggagcctgagtccaagttccagcctggctgctatcggctgtgtgaccactggcaactcgcctaacctctctgggcctcacgggctcgttggaggatgtggtgagagaatgaccgagatgagcttagcacagtgctggccacactgtcgctgttcaatgccaggtggctgtggcagcaacagggccctgcagtgtctccagccgccagcagggtgcgtgccgccactacactgggagcaagagggccctgcagtgccctggccgccagcagggggcacgaggccatgacaccgtgagcaagagggccctgcagtgcccccggccgccagcagggggcgcaaggccatgacaccgtgagcaagagggccctgcagtgcccccggccgccagcagggggcgcaaggccatgacaccgtgagcaagagggccctgcagtgcccccggccgccagcagggggctcaaggccatgacaccgtgagcaagagggccctccagtgcccccggccgccagcagggggcgcaaggccatgacaccgtgagcaagagggccctgcagtgcccccggccgccagcagggggcgcaaggccatgacaccgtgagcaagagggccctgcagtgccccggccgccagcagggggcgcaaggccatgacaccgtgagcaagagggccctgcagtgccccggccgccagcagggggcgcaaggccatgacaccgtgagcaagagggcactgcagtgccccggccgccagcagggggcgcaaggccatgacaccgtgagcaagagggccctgcagtgcccccggccgccagcagggggcgcaaggccatgacaccgtgagcaagagggccctgcagtgccccggccgccagcagggggcgcaaggccatgacaccgtgagcaagagggccctgcagtgcccccggccgccagcagggcgtccacaccgggccgaagcgagggtgaagcccgcgtcctcctcggcacagacccggggggcaccgcctcgctttgggacaactcgaggccatggtgagtaaaatccttcctgtttgcagccctgactactgagggttagagaccagtaagaggggtcggtgtgggaaactggaaaccaaaagcccctctgaatcctgagcactgaggttctccccacccaaggcgaggcgggcgcagtgcgaggtctacaccgcggccttggaacacaaatggagcgttcctaatgcagatatgcctcccgaaatacgaatgtgacactcgcagtgctcaggtaacaaacacctgtaatgctaatgcgctgcctcaatacaaaaatgttaatatgaaaccccgtgctccccacacggccccgcagtccccgctcataataatcaacactgacataatcaacacaaacgtagcctccagctgctcacagctgctgctgagctggagctgcctcgggcttggcctccacagtggagcttgttgtcgtatctgcttcacggacgtggaattgacacagttgttttaaaaagtagcttacttcccaataattccatactttcaggaaacttgcagcggtagtgtggagttttctttctcttttctctcagattcctcagcggttgttgctgagccagatctgcatctcacagaaaacaccccagtgtttttcacccaaaacagggacccctcccaggtaagcgccaggtgaccccagcacaggaggccacgtttctacctgagggtcgtgtccgcaggcccgtttcacttcacagccatcacggctgggtggaaaatgtctctttccatctgggtccagttttccttttctggagccttcgcagagttgaagagcagagctgcccccagcctgggtctgcacagcggttccccctgggcagatgcagacgccgcactccaggtgggaactcgcagcctctggcagtgctctgcacagcgagttccccggaggagcacagacccacccacaccccacagagacctcagggtgattgcgacaaaactctcctttacaaacaagtctcatcccatcactcttcttatttaactttaacgatggtttcccactggcatcagaacaggggtcgcagaactgacctggcccccagtccctgagcgctcccacctgctgccctctcccgcccagcccagcccagctgcctgcgttgcggcctccacctgcagggacacagcaggctctcgggagtcttgggaactctatgcacatccaacaccctcttatcaaatactcttaagattctgtctacctagatccttcaagtcacagcggttatgatgtctaacaacacaaatgttctgacgtgatttttttagaccaaaaaaaaaatgtttggtagatcatatgtgagaatcacccttaatttataaatcaaggaaatagatacataaaagcagagtccatatttgggataatcagtaaagaaaaataaaatctcaatgcagaatgaaaggcagagggcaccattgatcattgaaatttcataagagtttactggacagaatattaccttactatattctccagccctgtgtgtgtgtatgtgtgtgtatatcacacatataccagttgcaaaaaatttcaggtttaaacactcatgtttgcttttttttttttttttttttttttgagatggagtctggctctgtcgcccaggctggagtgcagtggtgtgatctcagctcactgccacctccacctcccgggttcaagtgattctcctgcctcagcctactgagtagttgggattacaggcgcctgccaccatgcccggctaatgtttgtatttttagtagagactgggtttcaccatgttggccagctggtcttgaactcctgacctctggtgatctgcctgcctcagtttcccaaagtgctgagattagagatgtaagccatctcgactggcctactcatgtttacttcattagtcaatacggttgattaagaagttagggttagggttggggttagggttagggttagggttagggttagttttaggggttagggttagggttagctttaggggttagtgttggggtttagggttagggttcgggtttgggtttgtgtagtgttagggctagggtttgggttaggagaattgcttgaacctgggaggtggtggttgcagtgagctgagagtgtgccactgctctccagcccaggcgacaatgggagattccgtctcaaaaaaaaaaaaaggatagtaatacctacttttaacagtcatgagcaacatttttttttaatgtgggtcacttctttatttttctgattgctagagccatgtctcaaatgcaaacatcctcgtgcttacttcatgcagcttcagactcgctctgcagacgagctgatgaccaccttctacaagtgctgcaattctcagggtggacactgctgtagggattaggactaggatggcccagctgcttcagtgtgtgcttaccttgtcccttggggtagatgcttagctggcagtgtgaatcgtgtatcctgagggtctttgctggtgtggtggaaagacaaaccttttgaggtgaagagccagggtgtcaggaaatgtggcctatctgctagtcagagtggatgaagtcatgaatgttggggagtttttctgtatgggtaggagacggagacccataactaagtatgtgctgtttaaagtcctgttccttcatcttctacatttattggcagttgacattcccttactcccaatcaatactatttttttttattttgagacagagtctcactctgtcgcccaggctggagcgcagtggtgcgatctctgctcactgcaagctccacctcatgggttcacgccattctcctgcctcagcctcctgagtagctgtgactacaggcgcccgccaccacttctggctaattttttttgtatttttagtagagacagcgtttcactgtgttagccaagatggtctcaatctgacctcgtgatccacccgtctcagcctcccaaagtgctgggattacaggcgtgagccaccgcattcagcctcaatcaacactcttaaatgtttgtactgtttgcaaaactgagtacattaaatgtctctaaatatttaactgttgcttgtaaacttaatttagtatttattttaatcaaaattctgaatatttcgttaaaatgaaagttctaatattgccttctcagtgttttaaatagcttattaagtagaaagcaaaccccaaatcacagtgatcccaaaattgactacatacttagatttgaacaggctatgaaaatcctcatcactggtatttcaatttatttctttactcctattcttattcccttattcattttttgaaccttccctgattgcttcctagggttgcattaaacgtataagattctattttttttttttttgagacacagtctcgctctgccgcccaggttggagtgcagtggcatgatctcggctcactgcaacctctgcctcccgggttcaagtgattctcttgcctcagcctcccaagcagctgggactacaggcgcatgccaccatgcccagctaattttttgtctttttagtagaaacagggtttcaccatgttagccaggctggtctcaaatcacctgactttagatgatccacctgccttggcctcccaaagtgctgggattacaggcatgagccaccgcgcccggcactatgtttttatactttatactttctgtgttaatcattcaactctcagaagagaaaggacacctcagactagctgagtctaggttcttgataattgattcttggtcaaggccccagtcttaattgctttctaaatcaatctctctctctctctctgaaagagatggggtcttgtttatgttgcccaggatgggctcaaacacctgggctcaagtgatcctaccgccttggcctctaagtagctgccaccactccccactccacatctttttttttttttttgagacagggctttgctctgttgcccaggctggagtgcagtggcatgatcttggctcactgcaacctctgcctcccaggttcaagcgattctcctgcctcagcctcctgagtagctgtgattacaggcatgtgccaccatgccaggcaaattattttatttttagtaaagactgggtttcaccatgttggccaggctggtctcagactcctggcctcaagtgatcctcctgcctcagcctcccaaagtgctgggattacaggtgtgagccaccacgcccggactccaaatcttttaatagtgtattcttgcttatgaaattgtgatacttaaa

SEQ ID NO: 1927 - DNA, 5652 bp, Homo sapiens
tggcacaagaaatagcatcaactataatatctggtagagtgtaaaaaagggtagagttcaagttcctaaaaatgttaatgcgccaggctatacgtaaagcgctggcctaggcactatatggatcaagactaaagacacaggcactgtcctcaggagcattctagtggagaggggaggtatccaatacaccaattacgtgaatacctggcttcctttcttaagtgtataaaaagcaaataaagccttaaagactgcttcacagagctctccatgagcagggctggggatacacagaagccagggaaaacagatacaagactcttgcagtcagcggtcccagaaagacaaaatgagggcttgtccaaaggccttgtactgggagtgaaggcaagtggaaggaacgagcaatggggacaaacaggtctcaaagggtgggtgactgcctagaaatgagcagaaggagaacttggaaataacaggtctgaacaaagagacagctttatatgacagaataaataagaagtatgttaggtagacaagagaaatagatgtggtcactgacttgtggagcctgaggagctggcaggggacattcagcataaatttactgagctcctattacatagcaggcactgttctaggatccagaggtacaagagtgaacaaaacaaactaagaggtgtgcagcaagcaacagggtaaagttagactctcctgctgacaggcaaaagccagaaatacagactgagaagtgtcaactgcaaatgagaaaaaccctcggttctcctgtattcaggagagtttcaagaagagagaagagaggctacaacactgaatacaggagtgagttggggaaacaatctggctggatgagaactgaacttaaccgatttgacatttctgtgactgttgagatggccttctccatcgcactgggccaggatccagcaggaggagatcacagcaagtgtgcctttgagaagtttgttattaaaatgaaataaaggatggtattttgatacatagttctctgagaatacagagaaagtagtgattcattctgaccaggagatctgggaatgctgatggttggcagtgaggatgtcctctgtttttgaacaataaatgcaggaaaagaaactgaaaagaatgccaggtatggtggctcatgcctgtaatcccagcactttcggaggccaaggtgggtggatcacaaggtcagagttagagaccagcctggccaacatggtgaaaccgtgtctctgctaaagataacacaaattagttgggtgtggtggcacacacctgtaatccctgctactcaggatgctgaagtaggagaatcacttgaacccgggaggcagaggttgcagtgagctgagatcaccccattgcactgcagcctgggtggtagagcgagactccatctcaaaaaaaaaaaaaagaaaagaaatggaaaagggatgatagagagtcagggttacaataaggtctcattacaatacagctttaaacattagaaaacaaacactgtcttgtgtaatcatacacttctaagttagacatatttctgaacaagataaaatgtgctacataaaaataaatgctggctgggcgtagtggctcatgcctataatcccagcactttgggatgctgaggcaggtggatcacttgaggtcaggagtttaagaccagcctgggcaacatagggaaacccttactaaaaatacaaaaaattagccaggtgtggtagcatgcgcctgtggtcccagttattggagaggttgaggtgggaaaatcacttaagcctgggagacagaggttgcagtgagccgaggtcgtgccactgtactccagcctgggtgacaaaatgagttgatcttgtctcaaaaaaaaaaaaaatgctatttttgtttaaattaggcaaatatacttatctgttatttaagactaaaaacctgatttcttggtcctccatctagaaaatagtctgttttaagacaaggaaatagttcttgtttaaactagagaatgagaagtctgtcagacacatggccccactcttgctccaagtccttctcacctattctcagataagacccagatcttgggaaacaaattaagggcgcatctgctggattggacctagctgcactgggagttgccagagtgctctgagcagcatcaggaattcctctgggccttgtcgtgatatcatttgcgcaatgtagcctgtgatggcagaaaattaagctggtatttatacagggtattagagaaggaccctccctgcaccaggcttaaagtgacaaaatgtcagcctcaatcatcccacaggctttggtctccctctgtaacctctttctttttggctgctctctctctctctctctgtctctctctctgtctctgtctctctctctctctctctctctctctctctctctctctatatatatatatatatatatatacatacatatatacacatacacacacacacacatacatatgacactaacagaaaaataaattgaaaagagcactgaggcagagtgtatttcacgcactggtgccaatgtttcatatctcatgaacctcgggaaaacaattcgtagaactaattagtttacagtgtttaagcagcttgttcctcgtctttaatcttctttatgtaatagtgtgaacaaagccatattatcttctgatttttttatacagtttaacaaatataatctcccttttctttccagagattacttcatttagacatcaaactatgttgttgttgtttttttcccctggggagaggggatataaataaattgacatctattcacataggtctcaatggtctaccagatccacccaggccctaatcctctttgttgtcatggaatccacctggcttaattatatttacagttttcaacgacaccacatggcatgcaggttttccctgaactctgcacatcttcccgaatcctagctataagtcacactccagctgctgtatccgtctcggattctagacggtgacaaggcactcttgcctgaaactcagcatcaggtcctcaaagaatagagcctggataaatctcccctccagtatttttatagcctactaaaagaacatgatttaagagaactcctgacctaaagccaggggatgggaaatagatacatatgtgtacaaattagttgggtggtcaggggagcaaagaagaacaagatacttaacttacaaaagttttatcttaaaatactgctcacaagtatgacttttaagagaaattgaactttttgtgctttctgattctagataaatatttagttgctaagctgctggaatgctatgagatacattttgggtagagtcaaactgaaatccaagaactgggtaaggctagtgttgaagtaattattattcatctggtgggtgatgctgcacacaaataactacttgcactgctaaggatttggagcagagttactccctgagagagacacttttcaggtggcagaaacctacctcagacttttatttatacactggaatccacattattaaagaattttacagtcttggaaaaacacaggacttggtgcaaactttcattttgcttgcctgagaactgtgtactgtcccatggtacccatctgccttaaagttcactctgtccttaattgtcaaacagattcatggtaactcctaattagtgcaaaacaggtaacacagctgcgactctgcaactgctgaacacctttagcatctatatcaagctaagctcaggagccctctctgctctctcccaaggttaatggtttcgagtcttctgagaattatggagtaggtgcccacagtgagagagggcgcctggttctccaagccgctgttcccactactaatagagtcagcataagaagcagccagtttccagcaacggtaacaatggagaaatttctcttactgcacagctgccaaataactttgaggatctgattcagaactaacatggaagatttaaatggatccattgcaacagacgttttgcatgttggcacactggaattagaggaactaatcagagccagagtggtaccagatggtctcttgagaattcttctgagtttaagatatgtgagccaatgagacaaactgtataattgcccaagattttactctaagagcactggcactgggagtaagaccactaggaaactcagctctgccactttccagctgtaggacttcaggcaaattaattaaataggatggtggtgaagaattaagtgagatactgtatctaacactcagggtacctaggtagagcacagggaagatgaggagctgttaactgtgatagttatgattttgtattttttttttttagatttctgagttgaggaatatttgcaagcaggtacagtaattacccaattcagatgtttatagaaaaagaaacacatcttaaaaataaaggtaccacaaaaaacaagaagtagaaaattggaagatggagagatgaaagaaaaatgaagaaatttcagagaaaaatgaaaaaacaaagcagattttaaaaagaaaaagaaaaaaaggtaggaaatacaaattaagaaatttcagagaaaaatgaaaaaacaaagcagatttttttaaaaaaagaaaaaaggtaggaaatacaaatctaagaggagggtttgaattcctaatcctgttctttttccttgcacttctattcaaatcccttttctgcatctcaacttttgtctgcactagatggtccaattctagccagacttcaacttgtagcagtcccaaggtagaaatgactagaaaaaagaaagttccctcttagctatgaagaatgaaaaacattaaaatgcaaattcaatgtaaaaaagaaagcaagactatacacacatttcacagtagcaaattctcaggcagaagtggaagccagcaagtaaccccctgaggtgtgctagtgtaactgtttcaagttttggggatgacagataaacagcaagtcctattactactgaatgaatctctctctctctctctttttttctctgggaagaaaatgtttgtgatagaattggtccttgagaaagagtgaattgatctgttagctttctgtgctggaccagaaataattattgccatacctacttcctatggattatgttcaaaagttagagatactcacttattctgtctttatgctatggggaactaatcggaactggggtttgcttcactgactctcacttattttaaaagtcaggcttagtaggaaagaaaaagtcaaagagattgaccaagaaaggatgaaatgttcggtctaggtaaacaaacactgtctcagataaagttctccacgggtctcgacctcaccttctactgcgtatgaattcattttacaatgttcgttttttttaagctagatctttgtgtgcttattttcaacaggggatgacaattgatttgttttctattgaacctcgccaactggatactgaagcgagcacggcatatttagatgcccttaaactttcaggttcacctttaaaacgtgccaagacaatgtcatgttgagggtaaatgtgcaattttcactaggctgagacgagaaatgagtgtctcg

SEQ ID NO: 1928 - DNA, 6966 bp, Homo sapiens
aaggtagcctttgtttttccgtatctttaatgcaatttgttctgaaaaactactgtgacattaataataaaggacaagctctgtaaagaaaaggtgcctaacaaaaacttggcaatgatctccattcaaagcaaaaatgctatgaattttaagataagggacctgttatatgttaagtaaaaatattcgtagtttataatttgtgaagcagtaggcattgcataactctgagaaaaaatgctgttcattatatgaatggcaatttcaaataatatcaaatgatttaagttcaaaggacttaggaaagcttcatggcatcctgttattaatttcacaaaaatttctttagaaaagaaactgagtcctacatgaaaaatgtaaaactacaaggtgcactgtgtactgattctccatgcaacaaatctgcaaacattgcctagggcatgctatatgggaaatctggacagctggaaatcatagtagacaaggagatttaggtcattgatctcagaattggaaaatttcccctagtgagccaatatgaatctggcacatatcactgatacacacacatacacccctcctatatcctcaaaaaagtagcatatcactaagagatatcattagaaaatgtatgcagtaatagcaaagcgtgtgaatatattaactgattgcgtagtgaaaatcttcaatattcagtaaatattcattgggtacctcctatgtacacaacactgtgagaatcagtagtaagagatataattaacatttgttaagtacttgctattctacattctttacctaactcatttaatccccctttcccatctctctctctttttctctcccccccaccttctcttggagataaaaaacaattatgatcatcaacatcagcatcatccccattttccatttgagaaaactgaagcctaactgaagtagcttgcccaaggtgatagagctagtgagcgacagagccaagatttaaaccctggcagtctgatccagtctacacattcaaccactatgctatattgctctaaagcacaaccacagggagccacaagaaacacttcaagctcttgagcacttacgctttatttgtgtacctctcactgcctgaaatgactcccagcttaggactcaccagctccatgaacccttcccagatttccctcaggaacagttgtctactcccttctctggtccatcaagatatcttgtacatattccaaattctgtacttattggaactatattataactatttgtctgcatgtttgctctttttattcgtgaggcttggctgagaattcaacacatagtaaacatccagtagagtaaatgattaacctgtcattggaacattacaatttagttgaagaagtagtctgaactctattggtgtaagtatttgtgtttgataatggcaaataagaataaaggttaccttagcaaaggttgctaaattatggactggggtgaagatagggctcaaacctcactctgatagaccttaaaggataggaatgaatcagatgactggaaaagaggagaggcaatctggggccagatgagcaggagcaggagcaggggatttgagaaatgagtgcctgaggcaggtgtggagggtgggcagcccatttaatggcaagctaaggagcctcaaatttattcttagggcactagagagtcttgagcatggaaataacatgatcagaagagcaaggcaggaaaaacagttttggctgcaggaaacacaaaggtgaataacaaaaaatatataatatctagattttgagggtgaaacctactcagaatccttctttagtaaggaaaaagacagctgaaacattcaccacctgctgaaaaaggcttgtctccaagaagcaaactgttactaatagtttttaatgtaagtaaaaattcattaaacatttattgctgctttattatcctacgggctaagaatacagaaataatgcatcatcttcagggataagaatctaaatttttgaaaatgaaatacagaatatggattagagaagtaacataaaatgatcaaaagtttgtatgtgaaggtcagaatgagagagctattattcttatataatatgatctgtcaaaataaaaaaaaacttttgttcaaaaataaatgatacaatcagaaaatgagaaaggacattagaagtaatctaatcccacagcattttagagatgagaagaatgggaggaccagagaagttaaatgatcacctccaggtcacacagaaagttgtcagtaaaatatggattacaaatctcatctcctaactatggttgactgctttgcctctgctgtttttcataaagctataaatatgactacactagaaaaataattctggtatattttggtataaaacaaattataagtctttaataacatccatgtaaactttaaaagattaaaacaatagagccaatgaaaatggatcattcattcatttagcagcctatattaattaagaacctagccagggaatgcaggaatggatgaagggtttggatataaataacggaaaatggcaaggcgtggtggctcacacctgtaatcccagcacttttggaggccaaggaaggaggaccgcttgagctcaggagtttgagaccagcctgggcaacacggcaaaacctcatctcctaaagataaaaaaaaaaattagctgggcatggtagcgcagctgtagttccagctactcaggaagctgaggtgggagaatcacttgaacccaggaggtcgtattttggatatgctgaattaaatataaaattaatatcaccagcatttttaatttcttggtaaaaatgtagctattagaaaactgaaaattatatacatggctcacatatttctattggacaatgccactctggagaatgagcaaagattaaccagctgtgggctggtgcatgcttagaaaggccaggaaagaggacaaggtgggatctaaccattaaaggataagaatctgaagattttttttgaaagactaattttcagggaattgtggggaagaaagtctcacagaaaaaaatgtgggtagttacccaaaagtttctcccatcatctttggaactttggccaaatcaggtgatgccttgggcaaatcaggtctccttcctcctgccactgaactaaacttgcagtttatccttctgtttgttctctgtggaactgtgagccaagtgaagtgcagatggatggcttcttggaacagaactgaaagcatgccagtacttaagttagaatagcatccaccttcagtgaccacagttattatgtgaacaccgtaggtcctcacgtgtgaggtcaccgtattatagaagcagctctctggataattattcacacagacacaaacacacacacagacgaatgtcatcagagttttttgctgtaaaacactatttccatctgtgtcttctgctgcatagtttaattcctgtatatgtcttttaaataaaaatgtgggcctcatctgtgttacaccaaccttgaagacatgaactgcagacaaattttcataataacttcagggctatcaaactggctagaattgaaatatcaaggtcagccctgccattttcaaattatcttcagccttgatataacaataatcttaattaaatagacttctaaaaactaagtgtaagtcaagcttgaaccatcactattttcagagtatactaaacagctagtaatacaagtataagcaataaattattcttgtttttataataatgagaaaaaagttctagaagttaattccacttaaaggtgtttcaataattaataatttcatttttctcatgtccaatgtcattacagaattaggtatattcattacttgaaacatttcatttaatcattcacttatttacttattgcagtgttcctttattgtattgcagttatttgtcctgacagtttatagttcctcgattaaatggatattttaggtattctggttttaattacctaggagcaaacttcaggtttcaaagttgcatttggacaaagtgctattcctataaatttatttataggatggcttcgctcttgagttaatcagaatttgtgtcacttacataacaatggtgactagcgtgacatgttagtagtctctaatgcaattttgctaaaaattttcttataacccattaatacataagagcagatgtctttagatacccttttacagactctttaagatgactatttgttcttttcatctgaaagaaccaacacaaaagagcaaaagtgagtgtcaactctttttcttttccttttttttttttgttttctgaggtggagtctcaccctgtcgcccaggctgcagtgcaatggtgcgatctcagctcactgcaacctctgcctccaggattcaagcgattctcctccctcagcctcccgagtagctgggattacaagcatgtgccaccatgcttggctaatttttttttttttttttttgtatttttagtggagacggagtttcaccatgttggccaagctggtcttgaactcctgacctcgtgatccgcccgccttggcctcccaaagtgctggggttacaggcatgagccaccacacccggcctgagtgtcaactctttttacaccccttaaaaatatactcatatacagatgaatggttataaatgatttaaaaacgtagatgaggaacactggaatacggccttcacgagggcagaaatttttgcctattacattcattagtatatttctagaacccagaagagtccttgatcctagcagatgctcaataaatatctgtgtattgaatggcacataatggacactcagaacataaatgtttaatgactgaataattcatggaaatgattacgccattagttaataacaatatgctccatgatcatcatttcactgtatgctactgtcaaaggcatttgaatcacagcaactccatcttgaataagggctatgtaaaatgaggctgagagctactaggctgctttcccaggagggtaagagattcttagccacaggatgagataggaggtcaacacaaggtacaggtcataaagaccttgctgataaaacagcatgtggtaaagaagccaaccaaaatccacgaaaaccaagatggccatgaatgtaacctctggtcatcctcgctgctcattatatgctaattacaacacattagcatgctaaaagacactcccaccagtgccatgacagttacaaatgccatggcaatgtcaggaagttaccctacatggtctgaaatggggagtaacctgcagttccaggaattgttcaccctttcccagaaaactcataaataatccactctctgtttagcctataatcaagaaataactgtaagtatccttagtctagcacctcaagctgctgctctgcctatggagtagccattcttttattcctttactttcctttcactttactctagggacttgcaccaaactccttgcgagatccaagaaccctctcttggggtctggatctggacccctttctggtaatactacaatatgaatactttaaatggtggttaccaggaagtcttaaatgtttatgacaagtaggtgcttagtacgttttcttgaatatatgagtaaagaaataaactagaaagactgggtcacaatttagaaaataagtcatgaggtgctgaagaccagaacagcccaatctttttttataaacctcctggatgcaagttttaacacagtctcaaaaaagttgtgatcagtttctccaaagctacacactgagactaggatgacaacgagctacctactcaggattttgcaaggaccaaaaatcttttcttactttacaatactctcaaacagaaactattttaaactacatggttaattcaaccttgtggactggatggtcatcaaaatgattatataattatttcaacatagttgcatttctttctttttctttgtgtgtgtgtgtgtgtgtgtgtgtgtgtgtgtgtgtgtgagacggagagttttgctcttgttgcccaggctggagtgcaatggcacgatcttggctcactgcaacctctgcctcccaggttcaagtgattctcctgtctcagcctctctagcagctgggataacaggcatgcgccaccacgcctggctaattttgtatttttagtagagacagggtttcaccatgttggtcaggctggtctcgaacttctgacctcaggtgatcagcccgcctcggcatcccaaagtgctgggattacaagagtgagccactgctcccggcaccatagttgcatttctaaatataaaatccccacgaagtttgaaaagatgatgagatcagggatatttgaacacatttttaaagtaaatggatgtatggaatattatgatagaatatagtagtagtggtagtcaagcatgaaactggtagagaaacaaaaatatacatgtaaaataaactcagtattttaataataaaataaatggtatcctaaaaaatacactgattttgtaaatctatattttgctattgtgactttctatgaatatccatttataaagtgttacattccaacctgaagcttttttaaaagtacaacaatctttttagtttcaactttaatctgtaaattaagtgccctaaatcatctaatagcatagctctaaattcatccttatcaccactgcctatttaacatcaaaactatcataaaaaaaatagttcttatctatcaatgcatacatatattacttttcttaaaaaaaacctgactaataatgtggcaccatgaacatgttatatgtagacatggtttgttcaaagggctaaaaaacaattatagccctgcctactcacaatgcattcccccaaattttcattagcttacatcatagtaagacttcacaa

SEQ ID NO: 1929 - DNA, 195547 bp, Homo sapiens
agtcctatgtcatgatcgaagaaacatttgaaagaagaatagattgaaagcatcatgcaattccactgacacacagttaagagtttctttagtactggcggtgtttggaagttttcagtaccgctgtgtaagtccggagaagcttcatggagaatggtcagctgtgtgatgcataagccacccctccctcttagtcttaactatttttttctcctttatttgtatttttttcttttcttttcttttcttttcttttctttcttttctttttttttttttttttgagatggagtctcgctctgtcacccaggctgggtgcagtggcgtgatctcgactcgatgcaagcctgcaagctctgcctcccaggttcacgccattctcctgcctcagcctcccgaatagctgggactataggtgcccgccaccatgcccagctaattttttgtatttttttttttagtagagatggggtttcaccgtgttagccaggatggtctccatctcctgacctcatgatccgcccgcctcggcctcccaaagtgctgggattacaggcgtgagccaccgcgcccggcctatttgtattctcttaagaaatatttcatttaaaatataatcaataccactttacaaagtatattatgtctcctttctttatagttttacaaagggcacatatatcagctgtatccagaatagcaaaaattaaagatcaaatattaatattatttctctctcttaaataccaatacaacaaaaatgtattttacataccagacattattttaaatttgctaaaaattattacctttatacggttttaaattttctttttaccagtttcttcatttgtttttctacaaaactatttgctaacttgcgtcaatgcctgcaccagtttctcagcatcctattctgtcatcaacttctttctcttaataggggaaccatttcagtaatctatcaattagtttgtgtaagaggcagaaaattaaaaatccggaggggcgcagtggctcactcctgtaatcccagaatttagggaggctgaggcagttggatcaactgagatcaggagttcgagaccagccttgccaacatgcgaaaccctgtctctactaaaaatacgaaaattagctgggtgtggtggcacgcatctgtaatcccagctacttgggaggctgaggcagtagagtctcttgaacccgagaagtggaggtgcagtgagccgagattgcaccactgcactccagcctggacaacaagagtgaaactccatcgaaaaaaaaaaaacctaggctatcaggtcatttactggcaattgcgattttagcatctataccagcatttttgccaaaaaatccctgagatttctcttccttcttaattttgcctgtagctctcagcatttttccagtcttaaggaagttgaaagttttttttttccattttgtttaaccattaacttccattctctcaaattgcaaatttaaaaaacagaagaatgaaaagaaaataaatctgtcatacagtgtacactgcaatatcatgaatttttgtacagaaaaacactgatttaaagaatttctatgaatttgcaaattagtaatttgaacaaatcactctttgatatctgaaaattaatgaaaagcataatttgtatcactttctcattaatattctaaattgtgtcacagcacataaaaaaatcgataaattatacctcaaaacatgaattaaaaagtattctagaaaactttttaaaagcattgatacaatggagtgcccagagaatttgtctctttctccattatgttttattatgtccacattatttatcaggggaaagaaaaacaattcctattaattatttattaatattaaaatattgatgagtattaaaaagtaccgggcttccagctggtgtactgagttgaacttttctgaaatgcagccagcacaaggggcgtgtattaaaagagcagaacaaatgacttattaggggtccaaaagcagcaatcagaaaaggttcatttaacatagcgatggcacaagcttcaagcaattgcctctacttaagtaagtgtggaattacaaaagcctatttattacagtccaacagggtcctgcagcttgctcaaagagctttgaagaaattcaacagttataaagtcctgctcagtgcagaagcagtaaaatttggacagacccccaaaacagcccacaaagctttcatgaaaaagttaatacaatcctcatcgcaattgttctttgaaatgaattgttttctcacttttctttttttaaaggagagatgctgtacctggttattttcaaaacttctttgaaaatgaattttaaccactaggaaaaaatgaaagtttcatggtggtatcaaattaaatgtaggacctcatgtgttccaacattaagcttcttgaaatgctcttgaaaccaacattaaatgtgactccgttaatggacttacttcagcagaaaaattagtagatttcctcattgtagaaaatgcaaaatttgagtccaaagacactggggctgaaatttttttattagtgattggataatgatttgatttttctaagtattaaagtaagcaaaaataaatttttttttaaaaaatccacatatccatttatttataattcagcaatacatttataaatatagaatatgtttatgaagcttcaactaaagtataagaaaaataacttatcttttgcttggaatcaattttagagagcaaattgcagggttgtgggggtgaagccaatttagggactaaaatagaggattattgaatagatgaagaattgataatgaaaggtaaatgatgttaatttgtatgaaaagatattaattcctaatgggagcaaaaagttggtaagaaaatgaatttactttttcatcagaaaagcaacacctacatttttccttggcaaaagattaagtcaggccaagtgtggtggttcatgcctgtaattctagcactttgggaggcctaccggggagaatcacttgagcccaggagttcaggatcagcctgggcaacatgacaaaactttgtctctacaaataataaaaaattagctgattgtggtggcacaagcctgtagtctcagccagtaggattgctttagcctgggaggtggaggctgcagtaagccgagatcacatcactacactctagcctggaaaacaagggcaaaaccctgtcttaaagaaagaaaaaaataataaaagattaagtcatcattcccaggccaatccatgcttcaattagaaggtgttcctatgagatctcacaaataataaaacccagttgatgggaaatattgcagtagattctattttttggtgtacagttttctctgaagtggcacaaggcaagcatcatgaaagtttctattataggtgaagaataaaaatgaaaagtgtttatagataggaaagtttgaatgagaggtcggatgcaaaaatcatcatgtgataatcatagaaacatcaacaaatacagaacttctgctaacttgtgggaaatacaaatacatgaggttcttatggtccttgatttgagaaaaatctatataaaaataagtgctttaacaatgaaaacaattcaacagttaatgtatctaaagattcctgagtttttgtttgttgtgtgtttgtagtttattttgctgcattccattaaggcagggtgccactgaactccagtgagacatttcgattggcgagtgaaccaagattgagatttgaaagcagaagtactttgatgatagtatgcatttttccttttaatggaagggtttgaagaaggaaatcacttaaaatatttttaatcttcagttagaaatgaatttgaccctatgatatctgatccaaacagatggggtttttattcatattccatactttcgataatgcttagcaaaacatagcaaatgtagaatcaccatcaaataagacatttcaaaacatgtctaggtaattgtaacacatatagcagtcatttccttggtacctctcattaagtatttttttaagaaataaaactgtacaaaagaagattgttgttccttttctttgtagtcaagagatgtttgtcagaagtcaaggcctactgtaatatgtcctaaatcatatctattttacaatatactaaatattattattacctatggataccatgggactccttgtgcataatggattccagtcctcttgcagagctgcatatgaaaatgttatcaatgagctgaagaatctggcattaataactttgcaacattataacaaataggtagtcctgatgttttgttctttttttaatacatcaaatatatttcattgcttacattatagtagcagattgaaaacatctgctcacttgccactagtccaccagcagcagagaatctcagcacattttccctaggcctgcatgtaccagggctataatccagctgttgagtctggatatggggccagattaatattcaagagccttggaaatggaaatagtgctttcttgccaaaaaactggaacaatgatagactccatttgcatgttcccttctccctctgttcttattcgccaccctttctaacccattaatttgcttccttccaccttcccctcccatcctctctttacagctccatcacctgtcctgacgattaagaaagatcggacctccagaaatagcatctctttgtcctggcaagaacctgaacatcctaatgggatcatattggactacgaggtcaaatactatgaaaaggtggggaaacaatgtttaagggttgggctgtgtaggcaagaagctgtttcctcatgagctgtgctcttgcaaagaaaccagtgacattcctggtaaatggtagagcactgtttagaactgtggccctgtgacccctttgatttattggtagaggaaggtttagaaagaatcttgttgaataccccctattctacagcaataaacaacatcaaagatgccactgccaacttaatccagttacttatggcaatagcatgacatttatctccctttacaccaagacccctactctaccaactattttattgtggtttcttagtctatttgtgaactgtttttttagttcattgcctcaagcatcatttcctgaccttcaaatttacatgcatttcattcaatacaaatagcaacattgtgctagtaagaaaaatattgtattatttaactgatgatgaaaagattttcttgaccctgtagaaggaaatttaaaaggttggggatagatggataaatttgcgtgacataaagttgtggcttggtaatgcaattattaaaaaaaataggcacatggttatttttaccccaaatttaaaaattattaaaaaatagttatgtggttattttgccctgagtggagtggcgagtattccatcattctaaataactcattttttttctggttgtaaatgatagtaaagtttaaagacaagatatgtttaaaccttagaatcacagctagttagtttcacaactactaacatgaacactacatatttgtgtatctacttcagtttataaagtgtgttaaaatgaattaaatgcaaattgtgcatttatatagcagtttatatttacagaacatttctgtggacattacttaagtctgagctgtataacaaccttatggaagtagcaaagtaagttgttttagaaataagaaaacagagagtgatgttatatgaatttcccacagcctcattgctaataaatattaggcatctgttttgaattgtggcagccgtgagtcctcctttagtaggtttttccctatatcaggtacctttttctacatgataatagatccttataagaattattggcataatcaactgtgcaaactgcgtaatgtaaaaacattgttttgcattatgtagttatttccttgcttgaagttaatatatttctctagtataatgtcatttttttcatagtctctcttacagaaagcctagagtatatcttttttattaaaagaaattgatgccaaataaacttcattgttcaaaaattgtagtagaaataaattttctcctagctttgagtcctctactgtggtaaagtcaaatactcataggattgtgatctattttcagaagtgtgacaagatagaatgggcaaatataataattcatgttcataaatgatgccacaaaattcttaaaaatcagtaatgtgcctcagttcaaactagatttcaggactgggagaagaacacctaacatttagatctatgaggttgatctcaaattttaattgtatacatctgcacctttcacaaacatgagaaatatgctgccttatttcaaactccctcaacaaatgcaacaagcatcattgccttttttttttttttttttttgagatggagtttcactcttgttgcccaggctggagtgcaatggcatgatctcggctcaccgccacctccgcctcccaggttcaagcgattctcctgcctcagcctcccaagtagctgggatgataggcatgcgccaccatgcccaactaattttgtatttttagtagagatgaggtttctccacgttggtcaggctggtcttaaacttgtgacctcaggtgatccacccgcctgggcctcccaaagtgctgggattacaggcgtgagccaccacccctggacattacttttaaacaatattagctattgcaggaaaaaatggtcaaatctattgattattccctaagtattttttgatacatacatacctgtaatattatttaaaatatattcctttaaatacatatttgcatcacatatacctaaatttaaaaattaattctaaatatttatagtatgcttggtaatatttagaaagattctctaggatttaaggtccacaaggtctagatttctggactggttatttcgctgatggtgattaacagtatatgtaatgtatggcatgttttctgtactattcaatctcgttttggttgaggatatacagcgtttcatattatccactctaggtcctactctaggtgcagggacattgtaccattgcttgaaatcaggttcctcataggagctctgtgtataataatatatgtgagagaaaaaacgtaattcttgataaattcaatttttgtaaacaaagcttgacacaaagagaccactaaaatgtgtcgtgtgaatctaatgtacaatgtgaatctcctagagatcctttttgggaagcatttctagcctttgatctggagatttttgtctctaccaaaccacagtgacttagattaaatacagcacaaatacagttaagctaaaaataatgtagagctacatataaaaccttgattttttatgtttaatattttaaggttgataaaaaaaagttctactccagaatcaatagagcattcctattaggtttaattcaaagggatattttcttctttgtaagtttgttattggaattagatttaagctttctctcagccttgactttgaagagaacatatcttctctcacatatttactggttagaataaagccaaatttttcctgctttacatgcaggacagaaatcataatattcaaattgggaaattctgtaaatatttttatttttagaaatgcccatgttgggacaggtgcggtggctcatgcctgtaatcccagcactttgggcggccgaggcaggtggatctcctgaggtcagcagttcaagaccagcctggccaacatggtgaaacctcgtctctactaaaaatacaaaaattacctgggagtgatggcgtgcacctgtagtcccagctactcaggaggctgaggcaggaaaatcgtttgaacccaggaggcagaggtttcagtgagctgagatcgcgccactgcactccagcctggtgacaaagcaagactttgtctaaaaaaaaaaaaaatgcctaagttgcgttcagagaataaaataattgaaataatcgatatgactttttaaatccatcctatgatttgtgttaaaatataaaagaatcaggtttgagtggttcactgtttatcattttatagcattatgaagatttgattttaacatgaatttttttttctgacctcaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacaggcggccgctaccatgcccggctaattttttgtatttttggtagagtccagatttcaccgtgttagccaggatggtcttgatctcctgtcaccttgttagccaggatggtcttgatctcctgacctcgtgatccgcccgcgttggcctcccaaagtgctaggattataggcgtgagccacctcgcccggctgtttaactcattaattaataaacagattagcaagagattaaaacctgtgctaagaaaaacttgaagaacagatacataattatgtgtgtgtgtgtgtgagcgtgtgtgtgtgtgtgtgtgtgtgtttaggtaatcataatatgctaaaaatgtgctaatatatcccacactggttaatatccaatgagggtaataaatgtaatgattgaggtcatctttcttacagggcacaaaccagttgtctttctagtaaataagtgttatttcaattgttaaaggaaaaaggatatatatcactatcagttttctacaacttaaattcactgttgtaaggtagcctagaaagatgagcaaagatgcacaccctttagaaatagattacccaggaaaggtctgacaatgctcaacactctgctgaatggaatataataatcttctgaccattcccatttcccattcttccctgacacctgtacttcccattttctagatagttagttcctgacataaaatctcattgttactggtatatttttgtgtccaaatttgatacctgataaaaactttcaggattgacctaaaaatataagaatcattctagttatatagtatttattccatcaagtttactcatgttggagtacatattttatggcacactttctgtcggacaattagaaatgctgcttacaataaggagctataaatttcaccaggtattgaaatgttaatgtttttagaaatcatctgctcatagctgaaccatgacaattctactcaaaggagagctgccatcctcaaatacgtaaatctattcttaaagacttcttttaatcctcacaataaaatgtgtatggagaaatcaccctcagaagatattagaaacaaaacatgaagtatgatggaaataatgcaagtgccaacaaggtttaaaacaaattaaaaactttagatggctcaataataaaatataagtgtaacttaacattagtacttctaagactttttgcaaatgttaagtggtacgaagaaagtttctccttttgaaatgattacagattaacttttctcaaaatctctttctttttttgtgacaaaatcctgctctgttgcccaggatggagtgcaatggcatgatctcagctcactgcaacctctgcctccctgactcaagcaattcttctgtttcagcctcccgagtggctgggactacaggctcatgtgcccacgtctggctaattttttttgtatttttagtatagatggggtttcaccatattggtcaagctgatcttgaactcctgacctcagggtgatccacccacctcagcctcccaaagtactgggacttaaatgaatatttgaaataacagcaataacaaaatctatatttgatttatcaggagagatccgaaatcatagaattagcaaaagctaatatttattgtgtcctgtggtagaaatcaggcatattatgaggcaaaaagctcagatcactattagataaacatgttttatgcatatttgggaacatccctctaatattacatggtcttaacacttaaccctctctgataagtaaatttgcaaaaacaatatattttaaaattgtaatgtaattccagatttaccacagatattgctgtggtagcatttatgcataaccttctaatgaggcttcagtgtctgaggtttaggaaatatctcattcgaaaactgcagggccttaggatttttgccaagtaagttttgtattagcaatgcttccattgattgagagagagaagaggaaaaaaggatggaaaaatatgagcctttttctccctcctcatttatttaaaaactgtgagttacacattttaatctttttacaaaagttagtttacttttgcccttatttcaccataatatttccagattttaaatataaatgagaaaaaaatgccttttgtcttaggaggtaaaagacaaaattttttttgtctcactctccctattgtttttattaaatcaaaatgacatattcctaaatgctgtaagtatttaataagactcttatttgttatatattgatttttttaaaaaatagacataagacttctgtttgtatttaacagtttgctttttccctctcgttttaatattttattttatttatgtatttatttattcttttttgagaccaagtcttgctctgtcgcccaggtgggaatgcagtggtgagatctcagctccctacaaaatccgcctcctgggttcaagcgattctatagctgggattacaggcatgtgccacaatgcccagctaattttggcatttttagtagagacggggtttcaccatgttggccaggctggtcttgaactcctgacctcaagtaatccgactgccttggccttcaaaagtgctgggattacaggtgtgagccaccgtgcccagccggttttaattttgtaattacataagaatgtctcattcatgacatgtatgcatatttcttggtagaacacaatgtattttgagctggaatttagataacattttctgaactttatagggaagagatggaggcagagcagagcacatattgttttctaagtgctttaaaatatcttatttttgtatgttggtattttatatttattatcatcttcattttacagttgaggaaactgagacaaagggaggttaaggaagttttccaaagtcacacaattggcaagggatacatcaattccagaatccaggtttctacatgacagtatataaagcagtatgataaacatttcatttgattctgttctataagttattcagatactattgtatccttttatacatgatccaagatacagattttgtgtgttttttttctgagtttacatatgtagtcagatggggcaacaaacctagaatctccaggttttgaagtcttgaaccgtgcaattattgcacatgaaaaaaaaaatactaagctaagacccatagaaagcatggagtataaaagagtaaaaggattttcctagcatgaaggtagcttccaccaatacaagaagtacagacattagggcatgtttggaaaagcagatagtccaattgtttggaaaccctcagtggggaaaaactgaagccatggtgtgtgctttgtgcacaagaaaatcagggataaagtgaaagttaagatcaaatacattagagcagctgagcattattagggtgaacttgacaagtcatttcaagtctccgtgtctcagtttttctatctggaaattggggaacatcatgtgataactcatgagattttaatgtttattaaatatgttattacttgtaaagtgcttaaaatagtacctcatatagcctcatatagtaggtactcactgtgcatgtgtgttgtgtttaaacaaatagtccgtaatttgaacatctgaagaatttcaagaataacaatctgtggaataaagttgagttttaaaattagaggatttcattggatattattatgaagaagacaaccccagggataattaaattagcgctcccgaaagcctcacaccctcattatttgttgttttgaagagtaaaaatggtacaactttactttcttgggccctattactagggaacataaaggaagcctgacaaagggagaatggaatcattaaatggagaaatttctatataaaaattaggcattcatcatctatcattttgtaggaaatagagtacttttgcaaagttttaaccagggaaatgatataaacaattgtaacatttattgagcacttaatatatgcttggcactactgtaagtgttttactagtactaactcatttaattctcaaacaacaaaattatgtcacacagcaaacaaatataaatccaggagttctgactcaaaagaatgaactctgaatcactcttttgagagagaaagccagcactctgtgtaggatggagtaaaatggaaatgaatagaaacagagggagcagaaaacaaattcaagttgaattattaagaaatgtaatagctatcaattacattaaattattagacacctatgtaactcatcactattagtcattcacatatttgctaattttagcaatggaaatgatctgatttagttatgtgctttagatagcctctgtgagtcatatattttagagacagaaaaaactgtggagaaatcctagtttaattctgttttcaacagaaaaagaaatagataattattttttctcctatcatagttcccttcccagtttcactgagctttattttataagctggctaatcaaaataaccacagaattcaaaccttgctgctttctataaattattacagtatgcaaagtgaaaagcatgagttcaagtcaccactatatgtttatggagcatttttgaaatattggattaagctatttcacaaatcattcacagatctgtagccaatggatagggatgtaacagccagatgctctgggaggaagatacaaagatgaaactataagagctttataggagaaatatttgtgaaggataaaaggcagatggagctgagccaggcaagcagaacctcagactgagatgtaggtctgtcatttataaaggcaaggagggaaagaagaaagagttgaggaggggaagccccagacagcagtgcagctctgagggttttggccaagccgatggggagtttcagagcacagatcacccatttgaggagtgttgcattgggcagggatggccaggctccagtaaccctttgccagtactgttaagtcactaaggggtacataacctgtgcttgaaggctgtagctgaaggtgctgcagctggaggctgtctgctgactgtactctctgcagcaggaacatctgagcaagcactcctgtgactgccatagaggtataaacaatagtttgctggtagtaaagagtaaagggcttacaacagtttatattatgagtgtgccatcctgccacactctgagcacttttcttcagatgctgctcacaggaaactcctaacaacctatctgtcacgtttcttttcttgcattatttaactaaccctaaaaccacatattttagagaaaatcttccaaacttagatttgttcaggctgaagatgatatgttggctcctggggaggtgatagtattcagataactaaaatctgctcttcttttgagtcctgaggtattcatgtacttaatcagcatttaccgcaagaacaacatatgcaaataagagcataaaagaggctgttccaggaattgtgtgtattttaaaatatctagagattaggatgcttatggagtttgtaggagatgtggctggggatttaaacatgaaacagattctaaatggcttttacacgctctgctatgaaatttgcatcttatcctgaaagttataaagagccaaaattttcctatgcaaaacttttatgcataggaatgacatggtcaaattcatggtttagaaggaatattctgaaagataaaatgtgtggaaagcatacaaatagagaccaaattaggaatttctaattataattcagaagataaatgaagacttaaactaggatatttaagagtgtttggtgattaactggaggcagaatgattaggagatggagaggagaaggttattttatatttatggtctagattcttgctcctcaaaatgttgtggtctggaatcagcagaatcagcactgcctgtgtgttcataagaaatatacaatctcattccccactccggaatgactgaatctgaaactgcttttccagagattcttgagtggtttttgtgaacattaaagtttgagaagcattggtctgggtcaagagtcagtaaacttttttctgtaataggccagataataaatattttaggctttgtgcacatcattctctattgctgctactcaacttgcccattctagcataaaatcagtcatagacaatatacaaattaatgaatgattgtggctatattccaataaaattgtatttatagacagcaaaatttgaatttcctagatttagaattttcacatgtcatgaaatctcattcttttgactttttacaactgttaaaagaaatgtgaaaccattctaagctcgtgagctgtacaaaaacaggggacgggcaagatttggctcctgggcttttttgccaaccatttgtctaggtgaataaatgggccatttataaaggtaggaaatagagggacagtttgttggtggtatgtgttgaggtccatgtattatatcacttttcaaatgaatatggatattggagttaaaacaagcttaattagaaagctttttataattgtatgctgagaaatcttcctctcttctctaagatcctcccataacttctggttcattcaacgagttttttgccattgaggacagagaaacccagtacagcatattttggacaggagacatttaaataatgtttgattgatgtcattgaaacaaagtatgtacccatattaattaggtagaaatttcaagcaaaattatgggaaatgtctatttttttaaacattaagtaaagaatactttcaacattgtatcagacattaagccatacttcaggtaaaagtagaacacatattaattaattaatgaatcaatcaactgttccatgtagatgttagtcatgattataatacctgttcttattttttctcttcaacctcacagctttctccatctctggtgaaagtagccaagtggtcatgatcgccatttcagcggcagtagcaattattctcctcactgttgtcatctatgttttgattgggaggtgagttcacagtctgtttcactattcactttctttgttgctttgtttgctgccactgattgctgttaaaatgtgaagagtgtgctcaataaaatattttaacaaataagaatgtctccacttgtagtttaggtcctctctttctcctccttttctttgtttctccatccttagttttgattttctgctctacattaaattcctgtccccactcttttaacatacacccctcctcttctctcttctgacactactcctagtttttactttctttctctaattatctcctcactcttcaaataaccccagatttccttgacactttctcacccagaacaggggtaacactgcacagcactaatcattacccatagagactttacccttcattccttctaacagaagttgttaaaaaatactataaacacattctaaagccattataaaaactgaactggagggtctgcacagtgggaagcaactctgtgtatctcctcattaggcagctttccagggttcccagagagaggggctttcttcagaggattttgaaaatatgaagttattaaactttcactaaagcatttaattgtttgaggaaaatgttttatttttatgctttgcacattctgagcataggtaactattttaaatatattcctcttatgtgttcgctttccttgatttacctccaggttctgtggctataagtcaaaacatggggcagatgaaaaaagacttcattttggcaatgggcattgtaagtttctaaacttggctttttgttttgcttcaccgttttagctttagcagttattgatttacaattggttaacttcctcctgacaaagagacttcaaaagtagttttatggaaaaactgagtacattaaatttattttagaaaaagagggaaattcatggttctgcattaaataatttttacatgtgtacatttcagcatacttaagctaaaataaagggtaatctgtggtttacattcaaataacgcacatgctaggtagtagaaactagtctgctctgcatggctgaaatgcaaagcgtatcttcaatttccttattactagtcctttgctaaactctaaataggagacttttctctttcctaactgccaagtaaatataaacaacctctgtttatttgaagtgccttatcccattttatcaaccaacctagaaagagcctttaaaataaactgtttattttgcagttacatgatatccaactagtagtaaagccagaactttctctccacattttaatttacccttttaattttttttaaatacacatttcagaaacaaagtgtttacaactaacaaaaagactttttttctttttctggtgaaacgaatcattccaggtgttttgcgttccaaactatggctcagcttagtgtggcaattactaatcagtagcttaaatagcatgttctcatggaaattagtacaaagactgtactcatgcttatgtgctccaaaataatctcaatataactaatgtagtcttgtaagcattaatttttttagtattcactattgccttctaaaattatttgcaaattgacatgatactttgtatcagccgttggattatcatctaaaaatgatagctttagttgtaactcaagtaaaaaacttgactacctgttgctaacctgcaggaagcatacagtagcttgaaaataatgcctttcaaaatataaattgatatgagaagaaagcagtataggagtttgaagaagcattattttgttcatccaattgcagcgtctataaaataattcacacaaaaaagccaaagtactacattcctaaaatcaacatcacatcagtccagattaattaggtgaccaactcaaaagtctaaaaagaatgcctgaacaagttacaggatccttgtctttctttttctcaatgggcccacaaaacactagtgttacaatttttatgcataaattagagcagtggcattcttgtggattaagtcaccctcaatttgacttggacaattgtaaatatcatctttagagcaagaccatgctgatttgattttttttttatgggaagcctacatcttacgaattttgagctttggtaaatttctgtgtgccaattattaaacaggttcctctatcgtcccagtctgttttgctattgtttttatggtggatttttgttgaaactttaatttttttcaaatgcacaatatccttatgacaaacaaaagagaaatgcatttcatcctggctgcaaaggcataaagtaacttatatgcatgtcataaactttctgcatcttaatactacagctggtttatttcagaccttttatttggtattactttaaaaagctctagctacgaactgttccctacagccttgttacaaatcctataatattgcttcaaaaggaaagaaatgtgtttcacctcctaagatcctgtccccttgccctttctggctgggcctttttacttctttgctatccttagggcaactcatgctggtaaaatggaaatgtaaattattgtgtttgcacagaatgagctgtaaagtagtgcagcttaacacgtgtgcatgtgtttattacctggttttcatgacagagcccagttactctgtatgttgcccttaattattggtgtgaagggattatgtgcctcgcagcctgaatcacctgattcctggaatctctggggtcagcagttaaagatcagcagccagtgcttctacagcgaacagaccattttacttgggggtgtatatgtttatgtttgtttttttcccccaaatgtcttatggatggaaaagaaattcaccttattttaattaatagaaattaataggattcattttatttgggaatggttatttaattttcaaattatttagtaatagtagtattgcatataggtatccatcatacatatattctctacaagctgactggtacttaagggtaaatctaaatcacacaatttcaagtctgtttaaggccaatgcttatttaaaatatgtgagacattgttcctaacaactcattttataatctttgtaaattctgatggcaggaaatctcccccacgttaatttccttaacttcagcaaagtaaaggagttataattatgtacaaaacagttccattttaccttatgcttaaagtatcattttatttccttgaaaaagattgctagatttctttaccttactgttactaagtaaaggcaaataaaaactggaagatcacacattatagggttgatctgatatgagttttcatccttaaaatgtaactaaattgactaaatgaaaagactccaacaagattttatttcctaacatattttagtaatggttacttacttttacaatttttcttactccacatctagaaaagtatgatagcttttccttaatcttaaagaagtttcttcttttaaaggtaaagggttttagtactggtaatgttagaagttattttaatgtaacaataaagcacaacagattactgtattaaagggtgactctcccatctgtatttataggaaggattcatgcttatatggaagaagcatataagctgatctgtgagctcaaaagtaatggacatttctaagtctaaattctaccattaggaaacatcaattatattaataattgtaaataaatgttcttaacaataaaaacgctcattagggcaatgagctctatcaatacattgagtgagaactatgcaacagtttctcatgctaggcatttgaatagtatagctttttttttttctcagagccctagcttgtcttttttgccaagatattcaagatgaaaaactctaaaagtgaagttctcacttcaacagctactccactcagagtttgtccaaagcaagggacagaacttgtatttccccatttctgtggatattgacttctagatagtggtgtcctttcaaattatccacacctcgcctcaagctggatagcagctgctcttttgttgtagctgtatcagcaccaggcagaagtaggagtcgtgttagcttttcttctgcattccctatttgccctctcaccaccatccctgctttctattatgctgtgtcaaagtcatgcaaataatagctgaggaaaatagagtttttacccaacctctctctcagccaccatttcttttacaacagtttattctcacacttacgtttttttactcaaaatctctatgaaagcttcacaagaacataaatcgtaatgcattataaccatgggtttcatgaagttgtcttgtagttcaaagaattgatcatttgttaacacatactgtgaaatcctagacttgttggcctaatgttcattgtactgaggcttcccagaaaaactgcgggcatctgcagtctccacaactatttaatacaaactacaaaactaactcaaagaaacgattggttcacgcagggtgttcaattgcaactttcccataattctcccattatgaagtaatattggaaacagtaatatctgatttcatttgttataatttaatgtaatgaatgaaaatatatttcactattaagtatccatattctgtgctaaaacacactattaagtatccatattctgtgctatgaatgttatcaaaattaaaagcaaaatcagtagtcttagcagatataccataggagttacattgcaatttcctttaattttagatcatatttatatagtttagtagatcttagaatcacttttttaaaactcagggtttttgtttagagaaagttaatttattgaaaattgcaaattgtctccactgttatttttccaaattataggaatcttattaatattaaatcaaattaaaatgattatcctgtatcagttgtctgtaatattttaactacaggatatgaacatttttaccttcagaataatttaatgaataaatataatatgaaggagatttttatttaataaattacatatatgacttacgtttggaacttagctccttagcgccattattcaactcatagacaatatttattttacttctaattatgttataaagctatacaatatgattatatttaactgatactatattggtgtgtatacatgtatgtattatatatacacaccaatataatatataatacatacatgtatacacatactaacagcttaaagtagatttgtaattacagtgggacattttgattgtgaatgttaatataagcagtacagtgtcagaaggtatgccattatatatcatttaatttatctataattgcagccattatctcaccttataattgtattgaattattttccaatcttgcattgtaatacatatctggttattataacatttgtgtaatcataaatatgcaatagcataatggtgttcactcactgttgctcctggtagtaatgactaggtctaatcagttctgaattatctttcttcttaagatccccttttttgagtatgcattttccttctgatgtttttgcaaagaaagctcctcattgtggttcctttatataattcatcatagagaacatgttttcttaaatttttcaacacagtccaatgtcactgccagtttctgtgatactacagaataaactgaaggttgtgcaccttatggggtagggatttttttaaaccaataatgccataaaatttgatctataattgtttgtacaaatctagctacaattgcgcctttctttctttcctcaaacagtaaaacttccaggtctcaggacttatgttgacccacatacatatgaagaccctacccaagctgttcatgagtttgccaaggaattggatgccaccaacatatccattgataaagttgttggagcaggtaaccacaatgaccctactgccaacttagtactgtatgtgaatcacgattgctcagtctctgaaacctaagtatattgctaaagaaatgggaattttctgatttcatgatcaaaggcaagtaataaataagtgcaatatttaatggaatgtaatgagttcaaaggtgccagacttaccggctcacagaccatggctgcttttgatttattaaatttctgatgtgacagcagcaacaactcaatcttcccatagctgtgctgatcgtgtgtcacaaaacctatttggctaaataaggataactggataaaagtctatttcaatttagacaacccaggtaatttgaagttttcattttcaattttagaatcatgtttggaattaaaagaacaaacaacacaaagtaatatcatgactcatcttacataaattttatcacaactatcttgggtggatattttaaataatataaggtgctccattttaatgcttgcttgactttgaatagtcttatgtgttaaagctttttttaataaatatacctttgttctaattattaatttaaacaatgataaatttgttaacaatcacctattaagtggttaataacagttgcatatttataagaaaaatttcatatatttgtaaaataacagtattttatatatttacacataaacacatgatatgtgcagtatgcatggaagtaaaactactattcaaaagtaaaaatgaaccatgctcaacaataaaaaattttgtaccatcatctaatccttcaatgtcactccccaaagcaaacataaactagttatgttgatacaggaattctctgtgtaacatcagatcacattttctgcaagtaccgtatttacatatttatgagtgatgtgtctttacaaaaatgtacatgtaatgctttgtttctttttctatacaccaaagtagtactgaaaaatcaagcagtagttagtatgcgaacaggacaatcttgtaaatataatgttaatttactagagcttctcttctaattatcttaatttcttatcctaaaatttacatgtgcaggtaatattaaaatatgaaacttgtgttcatagaaagaaaatggagtagtaacttcttttttacaatctaagacttgagagtaaacatattcgctgtacatctgtgctgatccagtgccaaaacagatatatattgtttactctgtttcatttcttcagtcctgacttctgaacagctccatgatgcagaagggtttagtctggctggttttaatgtttcctcacaagagtgcacttttctccagcacggagcctgcggtagcaaatgcagcacgaggactttgaacactcaactggagaatatgttgagaggaggaaaaggttacttatgctaagccactgtccaaaagccaggcagacattattatgatgttgaaatttaggtacctctccactgataaaatatctttatatagttattattgacagactcagatatacagaacatagtgatttgggaaaaagcacaccactgaaaatagcagctgataaatgagataaggggaggtctatttatactgaatcacttaatccctgatgctcattaaagattagaatagagcctccttcctatttctgtcttcaagtatatatgttaatgattagatatatgcccatgttcagggttttgcagccaatattcacatttgccatgttaagaacaacaaaactgtacttatttgcaaataggtataccttcaaggttagttatacttttcctgaaataattcaatacaatatacacacccaattctagactgccttgatgacctttcagagggtttgtatttaccaagttagaaaatgaaattattattcctaaaagctaacaatttgttaaacattttgttttgtaaaatgtaaaatatgtacacaaataaattaaatagtgtaataataaataaacctgtatgttactcatttctaaaatagcttttataacaatgaacaaatggcaaccttggttggtatatacatttacctacttcctacattcttaatcttaaaaaaaatatgttatttataaaaatttaataattattctaaattgattaccaactggcttccattgttagaaaggcaaacctttcagccaactacataactttcagagtcaattaaatttacagaaagaatatatatatatatatatatatataagctaattctcttaaatttctgtcagaaattttacataaatgaattgatgttatggaaactctcttgtatacattggactatagaaagaattatacttatactataaatgataaaattaagacatatgaattagcttcccacagtagtagattactagaagtgaggaattcatgactacaattcctaattttactcctcaatccaaccattctttcaacgattgaatactaaaaatttctgaagaaagtaaatacttagtaagtccttaatttatcctgtgcattcccatgatatttaattttattatcctttttagataggtattattatctccatttcagcacgtgaataaacaaaagctgagaatttgaatagacttgtttggatcaaatgaaaaaccaaaatttgaatcttatactttccaaatttaaagcccatgctggacactggagatcatagtagtgtcttcttcatagtatttttttttgaggattaaacaagataagttgtgcaggggacttagctgacacagaagcattgttcaatatgtgtttttattatgcttactttatgaaaacagtagaaggagggtaggctttaaagctagtgttggagggagtcattctatttaaatgtcggctttttttaattgtttaaatgaaattagcataagaaattttattttgagcagcttttacattgtgcattttaatcagaatacagtccccattcttataaatatacctatttcaaagagcaaataaaattgccgcacttattagaattaaaaaatcaagatctggcagccatgcttttatctagaaatgacaagatctgaatttttgtttcatatgggtgcaaagttaattgaataagacaatataaaacttggccagatgaaactattgcaaattgcatttgcccagtctttgttaacttttacaatacagttcttttattttttatttttaatctttttctatttttagcagctttattgagatacaatttaccaaccataaagttcagctatttaagtatacaattcagtgatttttagtatattttcagagttgtaataaccataattgctatcccaatgcagttattttaaattattaaaaatataattgaattaatattaagcatttctatgtcttttataatatattggcggctatttctagtgtttatctgatgaaataatcacattactaaatgtggggaattttaaaaactagcattgctgaaacacaattttcatgaatttcgaaggtaaatatatacatgtacatgtttatgtgtccaggtgtcccacttacaacaaagaacactcttaattggctcatttaaaatttgaactcctacttttcatatctctagtatgctatcctttacaaatatatgtccagtaagacatgagccttgttatcgccatcattaccataaccatctcttacattaacatagaatttggcattttataaagcactttcatattcatttgtcagtttgatttaaacagaaactcttaaagggtagttaggcaatttatcctttaggtgggtctgaactcagagagataaatagtgaccaacacttagatgtcacctactgtgtgtctggcactgtttcaagtacttaacatacattagttcctttaatcccacaacagctttatgaggtagatacaataagtgtcccccatagagataggaaaagataggtacagagaggttaagttacttaaaatcacacagctaatatgtggcagagtcagaattggacccgaagcaattcggctgcaggatccatgctcttaaccagagttctgtactatcactcctgtaaactgacaagtgacatgtcacttagaatatgtgatgatgacatctacatttaaaacatgctctattataccatgttgatgtatgataatggcagaactttctggttttcccaagcttagtgtttacacaaagtgaaacaaagtaaatgggagcgctctgataatgttcggataaccctatatgaggaaagaaactcttactcttgtttacaattctgagaataattttatcacaccataacttctctttctcctaatattctcatatctaaatggcatattcttccttcgaattagcaagatcaatgaactttctcaagttctactccctgattctttctgtatcctaaggaacactatagctgtagatatcattatcttctctacacttcctcaaagggaataaactagtcctgtcttgtttaccattatatctatctctgtgtgttttatactgtatgcaatacagttgctattatgaatatttattaaataaatgcatgaatatctgcttttggattttaagtgactttgccaaattaaagcataagtcattgctttgaaaacagggcaagagtggatttctggggatgagtcaagcctggggaaggttaaagcttcccagggagagagacaccatttgtagtaatgtagctggcaaatcaataggacaacctgctacttttgtggttcaaaccacttgcttgaaaacaaaaatagagaagaatcatatcacttcaatctgactgacacgtagggcatgaagctcatagaaaattcacagagagaaaattggaccaagattatgattccactccatcaagagccaaaaattaatcatataattaattctaaaatatttcaagaaaagctcatttgacattaaaaactatttttaatgtgatgcaaaacatatctgataatccacactatgttagaagttcttctgtgaacaaaggacattctatagaactcccatgtggcaatcatcatggcagcatgggtacagataaataaatgtaaagggtatctgctctaagtgagctccaaatgtaatgaattgatgattagtaaatctctcagtaaaaatgtattttgaaggtagtgtccatactagttctaggcagttttatatcaactggactataatatttaaaagtcagtaacactctatatgggacaaattctggattaattgcacattgaagacttttttttttaaattgaagaagatgaatctaaaatatttctacagtatttagataaggcatgttgtttttatttgatactgttatattgttgttgtcctccagaagcccagagacttttatagctggtatgtcagtaaagcaacacaccaatactccaataaaataaattgatagcagatgctttccttctcatttttagagtctgaatatatagccatattggccctcggtaaaaacagaattgttaaaatatctgaaatttaatccaatgctcacatttaatcactgttggtgctgtcctgttaatttctctgaggtaatggtagctatgacaacaaggggtaaaaaatctaacatatgcagctttcaacttatctctccttttacattacattatttatagtgtcgtactttaaagtatatggaattttcacaaggttcattttccaacagggggtgactatcctgaggttttctaggcagtttcatatgattatctttcaaaataatttggagtactagagtgtacatcttgcaggtcaaaggcacaaatattttaaatggaaattttgaaataaaacagttgctctctactgatgaatttttattatagaattccttacattttgttgctgttctgctttataacaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagtaaagtagtcataagacctgtgtttccgtatgttgagcaaaggttgtttaaacccaaccccaaccatttaagaattttggctttttttcataagtatctcagttttaccaaaaagaaaagtttaggaatagcatgcctttctttgacagtagagcagacctttaaataatattctattgacagtactgttttagacctcaaaaaattttaaaaaaatactagaagccacatattagaccatttaaaggtacgctgattagcagacagttaagagaagaattgtggggaattctcggctatgtaagtagcaaagaaaaacaatgactcaagcttgacaggaactcccagctagctgccttttcttttattgttcatcagttttatttaaaagttacaaatctttaacctcctcccaccccctgcatccctgcctttaggaaaattttgggagtctaggaaatgcttctgagctgtacagattggaatcacaatagacccaaggccgtttcttggttctctgtggattttaaatagttctgatctagaaacccaggtggattcttactgctctgtggaagctctggctcacagcccatgatagagatgtgaacttatttccatgatggtttctccagcaggtctcaaaagggatcctgtgaggcggatctgtgatttttggctccaatccctatataagtctcttgagaatactctgggacatttttcctcaagattttggagctcaggatgaagaataagtgaaattggcagcaaactttttagagtgaaagacaacatatggcagggaatttggcatcctttaggggataattcattggcaccacatttacatactctatcgttaccaacagacatatttttcataattatatttctctttaccattttatagagcattttccaaatggcactaatacttattctcactttagcatgactaaaaaggcatttccttcctcatgagagcatggtttaattgaaatagactttgatttccttttgagttttcatatataaaaagtggaattaagaatttaacaatgtggaatagttcaacatacattgtaagtccatattaattcttataaggctttttatttgtttgcctatgtactctacaaaaccaggccttattaatagaaatattttctgataaaaaacatttttaaattttaagttaataattaataaaaatgggcataattagtaaggattgggaaagtgtatgaatcctttgttctttctgagcaaggctatactgttttatgtctgtacagttacagtatcatgtctcattgggattttagtgtcatttagccatttaatgttctccattacatctgcatcaagtggtggttgccttttagctcttgagcctcctgggaagagaaaactcccttgtacttatgaagccattcttctaactctcaatttttacaagtttttcattatgaagtatctgttatgtgcccacattatactatgacattatttcattcttaccactaccctgtgaattagacatgataatttctctcttacatttgaacaaacaataactgtaaagggtaattagcttgtataactagaaaatgctagaggtagcactgggaacttgttctgttcatttcaccccatccccaactctgaacccaaacaggtttctacttgtcttttcctgtattctacttattcttttatatcgttactttaaaaatcttctctaacatagtgagacattcctcaatcttcaaaaatttctggaactattaataatccttaatatctaaaacaaaatataaactctcaaagagggcaaaaacccatgttatttgatgacaagtgactaaaataaatcctggatcataatagatacttaatttaccaatgttgaaaaattaaaaaaaatattgatgaaggaaggaaggaagaaagaaaagaaggaaggaagggaggacacaacaatatcttttaacaataggtctttctttagtatttgattcattaaattgaatacacttttcaaaggagtgcatttaaataactacttctatcacccagagagtgatgaaaaaaaatgattactttttagcttgaatagaatcataatctaacttcttcaacatgtgtaattaagaaaaaaatgagctaagagtcactatcacacaaatattaggttctaatttaagcttactaataaactcactctattattttgtcagtcatgagttgatttttttgtttcagtgttatgaattatgaaagctactccttatattttcctgtttcctataaatgcatttactggatgataagcaacattaaactataaatgttgtggcaaatttcctttagatataaaactgaaacaattaaatatagattatggtagactgacaaatctatgaaacaatctctaagacaaaaaatgtagaaaaatgcactaaaatgacttttaaaaattgcaggtattatatattaaacatcttactcaaaccgactctgtaacattctaatatggattacaactgccttattcttagggtgagagttctaaatttgatatatctccctggtcaaataagcatgtaagaagctgccaaatctgactatataaatcccagtcatctcatatattgtaaatataatagagtagtagccctagaattagattttgaactccttggtggcatatttataagctcttagtctggcacccggtaacatctgagaggaaatagaaactccttacaataaagttgatatgttgtatttaacacacacacacacacacacacacacacacacacacacacagagcgattgtgtttccaaaagaagctatttattctactgctattattgtctttgtttcctgagatttctaaaacaatccacctgcagagatcagaaagcacatctatacatgcacacatgcacacacacacacacaactagagtgatgcagagcttataatttaatgaacaaaataatattttcaaaagcaggcatatcagtatctagattaataatcaatgatctgagttcaagttctgaaacaaccttactcctctgagaactcctacaaatcagacaattcacacataattcatttcttcgcttgtaacaaaattaaacagtactactttactatttttagatactaaagatcaaatgagattacataagaatatattaagtggcaaagaactgtgcaaatctaaattactcctctggttgtttgagattttaccaatcaatttgggtgtatagaaaaaaattcttgaaaataattctttttttgctcaaagataaatctgtttattattgttattcgattgtgtgctttgaaacactaggtcaaatacaatgtatcattttcaaatcatttgaagaaaacttttcttaaagctttttattcagtcattgtattttcatttagccacaaacaattttaatgtttttgagcctgatggtcttaaacaggagaaggtgagagagtctctgatcttcaaagtagcagaaagcggggggcacaggctctgctcacaacaaggtactaacatgtgttatcaattttagctgaagttcaaaaggatagaacttgttcttagcaaatgtttgatatttctgccatcacaccattagtcaaataatgttcagactccaagaacaccttccattggccacttttcacctagcgaaatagaaggaattatattggatgagattaatgtattttgtcttgcattattttcaggaaattttaaaaaattaccatgtaacttaagtgtaactttgcattattgaggaatgtcatgggcagaacgttaagatgattttcataattaaaacttatctgtagtggcatgagtatccactttcactaaaagcttagccattggcttccagttgcctgtttccctgcatgtacggtaaggacacatttctggaataagaggtcatcatttagtaacaatgccaaattctagttattttctgtttgtttctctctaaaaatattctaaatttgtcttaagtgtactacacttcatgtcatcttaaaagacaatacatacgttgtacttactatactagtaatttacagagatagtttgttaggataacaaattttggaaactctaatgacccaagttttatcatggattcatggctgcaaattgttaaaatgagttcagaacatgtctgtctaagtaaccacatcaacaaaattaaaaaatcactgctcgatatattagaaaaatataagacagggaatgttatttttacatatttaaacagcttttgttacttcttcatcactgtccacttatgtcccttggatgaataggccattttgacttatagaaaagtgtggtattgtgtatttttctcatttatatgtataggatggttttctgatatttttgaaaaattaagatcaacttacaaaatttgttagagcacgatttgtgtgtgcccaaagacaccatttctagagcactggtttacatatacagtaaatctcctagagaaagaagaaatatgatgaagcactagtttagtagctgtctgaataactgtggtcttacacaacctttgcagaaagggaaaaaaagtatcacctctaaatgccgaggctagtaatatcttgataccaaactatacagctattatcagaaagtataataacattattgtaatgcataaacaaaaatttaataacactagaataattgtgaagccatatctgaaagtgtatcaaaaaagatactacaccatttcccaagtgtagtttattccaagtatgaaaagttggttttgtatttaacaattctaaaaactcataacattaataggtaataagaaagttctatcttaataaatgcaaaaaataaactattttaattttaattttttattagcacatcatacatagaaaatatgtattcctgataaaggtatgtaaacagcccccaaacaaacacaaacaaacccacaaatgtcacatttaatagtaaaactttaaaagcatttcttttcgagagaaaacaaaaagcctgttgttattattatttcaattcaatattgtacaggaaatcttaaacctttttttttgacttttacaaataaatcagctcctttatttgcattattttgagcactctgataatgacagtcttcactgatatttttgaaatcctgttttttgttaaataagcttttccaattaggcaagcaaataaataaaagaaagcttggaaaggagaaaaaaacaaaactttttatgaaatcaaacaacatattaagagtattatatacattcattccacttactgtatgccttacattattgtgcttactgcatgactcagctctaactagcataatggacagtaaattagttgttatctttgaagatgttaaatttcgtttcaagttaagcataaataaatataaatatttttcaagcagctgaaagtaaagcattctatgtgttaggattgatagagtagggttggttaaggaagtcttggagaaagtgtttctcatcctgattttgaagaaagaaattatctctagccagtctgaaattatagacctaatttgatcaattgtaactggcacagtggtaggtgttggatttagaactacagacaaatgggcttggtctttgctctcattaactcatagacgtaataggggtcatttccacacaataatgtcttgattaaaatggaatttggaagacgttgccctgtaattttataatgatttaataagaaacccacaaaaaaaaataccctaactcagctcaatatttcatttcaatatttcagttcaatattcattacaatatttttatcagttaggtatgatatgtgaaaatctatgatacattttttattctcatcaaagatgattcaaatcttctttcctggaaataggcaaattttgtcaatttttttcaactttccatctcccgttttttttttttttccttccatcctgacactgattatatagattgctagcggctaaggtcaaaggttttgattttataatataccctcattagagtgtgtttaatccttttgaaaataagacatagagtgttagacccaatgactgttgttaatagggagttaatagcatttccatttgaaattattaaatgtaaatatttaataatgtttcaatatctgataaacagtttgtttgaatgaaaatattttaatctgaaaaacaaagtttgttagaaaatttcaaagaaaatatctttatgactgactatatatgtatatatatatgcgtatgtatgtgtatatatttcacattattctactctataagaaatgtgattgagaaggttgtgttaaaatagctggtgctgaatctggaattcttagacattttgaatcatatttcttctgtcatcaagcggcgattcaatgactagtaatagctccgagccactggggatagttgggaaaaggaactgattataacagactgatttgcttccctttactttacaattgtgaaagatcatcattttatctaaactcataaatcaacttgagaacaaaagcaaaactccactgcaaattttgttttgctcatttttgatggtttcatttcagcaagtcatagaacagtactttcattgagtttagtatgtatacccagatgtgttttggggtttctgagagccgcaaatgatacaagctttgtctggaggaagacgatcatgtcatttgtaaatcaaaatacacctggaagagcatgcaaacttgagtacaaatacatggcataatgcgcagatgagctggcattttataaataatttcccaccacatttaatgcatgttggaactagttctcgccactacagaagtctctttttctttaaccctatttaccataatcaaaatcacaagggaaaccctaagtcaagatactgtttcccaaggtagaatatttgtaattctgtttactctttgtatatttgatttgcagaatctttgaacgtaatgcaaagcacattttcagacttgcccatcttaactgatgtgtttacaaatacctgaattctagagttaaatgcacgctgatgtgatttctgaatggtcatggggctttgacttaattgactggtttgatttttcagctacttttatttcccttcccaaacatcccactagacatgctaatgagaaatggtcataaggctgggagccagaaggaaaggagtgataagtaaaggtctgagtagtataaaaatgcagtaactggccaatgatattgagagttggtggtgtgaggcaaaatatctgtgactgcatttgaagtgtgcattgaattttggtaacatatcattcctcccagcactgtatgaaggaggaaagacagaaactgatggtgatttatagaaagtacacatatgcaggattttattcattcattcatttattcattcatttcatttcaggccaggcatctagaatcaaacagtctctagggaactgatactaattcaggagagatctaagtttccaaggaaatggtgaatcttccctttctttttgaatattgtttaatcaaagtttagttggaattttgataaagcaaattctgggggctcaaggttttgactgaagcaatttttcagatattactacattaactagatagatgttacatggtgccttaaagacataaatcagtgtcttaacggaaaatagatcaatgtatcaagtggttgtaacatgtataaaagttatctcaaaaactatagaatttaaatagatttttccttaataaataagacataattcctggaatatattcaaattactgaatgtaaaagtataaccttcatgatgctaactcataatttacattttgtacaaatcaaagagttttttacacatgaaaggaaaaaatcaagaaaaggaagttattttctagcatcagaatggcaaactaacctcatgataaataagacacataggaggaaaagttgtgttatacagttatgtgtacattaatgtttgtttaacatctgttatttgcttatgagttttcagcagtactcggttaatactcaactcacgtcttctggacttggaaaaggagtgattttccttcctgtaaaatgctggacttataactaaaatagtataagaataataaagtaagggaattacagtgtggtaatatgtataggttttgaaattagagacagtcgtgtttaaaattttcttgactgctatctaattgtattacctcaacaagttgcttaaacccacaatgttttctgggtaggaatcagtaaaatgggaataatgcatattgctaaagcataagtaagctgtgaggattaagtgatataacaaatgtcaagtacctaatgcaatgttacataattctaatcatgaaaaaaaaattaccagtatttcttttatatcaaagcatcctttttttggtatttttctttttaaaatgttagttttacataatcttcttaattgttaccataatgtatatagaattatattttcagctttgtataatattacgctgtaacaattgtctaaagtgcttaagtcttaaggtcatcattttaatttaaaatcatccatagctttaacatgcaataactgactaaatcattatctgtagtggaacatttgttatattcatagctctgtgtatccactatacttagcacctttgtgtctgatgctttttcatatgttacatttttccctcattatcagtttccgaaagtgacagcatagtgtgtacaggttgcaacttttagctttataacttgttagatgtatgatgaccagcaagttaattagcctctgtgtctcagttttctcatgtgtaaaatggaaataataatacttaatatgttaatatataaattaattacaccagcatcatgctcacaataagtactatttaaatacattaaaatgctgggttaaaggtttcatggtattttaggctacatatttgcaaactggttattacaagttactgccaatagcaattttaatttcagttttattttccatttaaacatagcattcatttcataatttttaagtgttaaacaaattttgtaaataattataactattattctgaattgttttgtagaactcgtgtagaatccataaaggcagaaattttgatctacttgctccccactaagcggcacaaaagagaacacctagcacagtgccctacacgtatatatgtgtgtgtgcacatatagcacatataaatacccatagaaagaataaataaatgttaaattcctaacattatcttgggcttggaggcagaaatatttggtgttgaagataagtgagaatttaattaaagagaggaaaggggcatattttttgtttacttgaaaggcctgtcaaaccaatttagatgctattggtcatgggcctttgttctggaaaccaatcttctccaatttttgtggtttttaaagttttattttctaatgaaacctagggctttttaaaatttttaaaaattagaagacaggcaaagttcttacatctctataatcctcaggtaaatccaactatattatatatgttcattgtataatacttgaactgtactgattattatttattatttactgtatatctaggtaagccagttatgattgtcacagaatacatggagaatggttccttggatagtttcctacgtgtaagtaagatgcacacacatacatatatatgaataaattgctgaaaacattagagacaccctccaatattgtgccaagcaattcagtaatctaagtttaaagtaaaactgaaatcttctgaggctaaatagacagagaagggctgtaaaattgcatctttttttgcagcattcaaatgttaatggtttatatttttaaaacaaatttgtgagttcttcttcaaaagactctttttatactgccaagattcacactcgttaaataaaaataaaaaagaatcctaaagcaagtaataaaacccactgatgtaagacagaaagtctcttttttaagtaatctcagtctgatataattatttaatcacagtctgatataagacagcccatctactttccaaacagtgctgtcagaaaataagcatgtgctataatgctaaagtatatatagttttaatttagatatatcattttgctgttagatatgtacattaattttttagattgagaagctttatacgtttatctatcatctatctatctatctatctatctatctatctatctatctatctatattttttgagatggagttttactcttgttgcccaggcaatggtgcaatggtgcaatggtgcaatggtgcaatggtgcaatggtgcaatcttggctcactgcaatccccgcctgctgggttcaagtgattttcctgcctcagccttccaaatagcagggattacaggcgcccaccatcatgcctggctagtttttgtatttttagtagaggtggtgtttcaccatgttggccaggctggtttagaacccctgacctcagatgatccgccctcctcagcctcccaaattgctaggattacaggcatgagccaccgcacctggccatattttgacatactatatttcaccataagaaagtgaatatattaaatttacatctatttcaacaaatgttatgttcaacaatttcatgaagttcaagacaataccaattaccagtcattgcaggcgataagaaaagacataggccctgtcctcaaggtgcttttgttgctatataaattgagatgggcagatgacagaaagatagatagataaatagataaagaaaatatgtagtatcattcataatcatggaggaaaattttaaattttctaagactgagaaaggatatgctttatattaaaatccattagccaaataaaaattttaatagcaattattttcataatcgttatttcaaaaataaacatttccaaaatcaggtgagttaaaatattatgataaatattctttcaaaattatcgtttgtaattaaacatggaattttatataaatacattatctatacattttaaaccttatgtttctattttaatccaagattaaattagattggaagctggattatgtgatttagtttcttattgctttctattttgtgactacaattcagaagtgggtagaaaaacaaatatccaataaatatttttgactaattatgaactaattatttatgataatgtttaaaaatgtagcatccaccttatttgaaacaattcataaaatatcaggaaacaaagaaggggaaatgaaaattcaatcaaacaaataaatatcaacctaaactagccacaagattcatttcacttttttgttcttaaccttaatgagtctgagcaggagttagtttttttgtcacataaggaccaggaaagtccttgcttttaaactgaagtcaaagaacgttaagatacttcctgttacaaagtatttgataacatagccagtgtgttattttgtttcagccttgtatccatttgccacatatctttgtcttgagtgcttaggactaaagtgtgtatagtcagtcttgttacaaaattcaatatgtgagattttaaccaataaagatatatctttaagaaataggaacgtatcttaattgtacatttgaaatgcttcccagaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagagtgagtaacttagattttctccttttttatcattgttttccatcttgtatcatgttgatttgtaaataagtagaaatcatgacccaaaacgtgttgtcaattatgctttccacaatagaaaacatatcttaaaattaaaatattattatttattctgggtaaatagatggtcactgtttaacatttaatgattttaactctgaaattctatacctcagtttaatgttccccaccaaaagcagcaagattctcacattcctcaaatcttgatatttttaaatgtacccatcttttcaccatggttgagtcaccctgagctagcagattggataaattctaaggaccttatcccagtacatatcattttaaagcactttcaaatcaattttttaataagtaatacctatttatactgtaaaaatgtcaaaacagacctataaagaaaagttgtccataattgtgccatccacagacaacatttataagattgtgagtcaattcttacaaatttttcttcatactcatatgtacaaacttgttcatgaatatattatttaaatacaattattcataatacaattgtatgccatttctctccttaccaatacacttcttgaatatatttcattgtcaataaataatctttaaatttttacatgtagtaggttgctgtattctatattgttgtatcttttttaaagcaaaccctaattagtgagcaaattattattatatttaatttttccatattttataccaatgtatgtgatctgcctgcattcataattgttatgagcctcatgattttctaatgatacattcctaaaaatgaatgttttgtgtcaaagattacgtgaatattttaaaagcacactttactacactcttgataaaactaggtattttcattaattttactattatcagttaggataaattgaatgtatatgttttaatttgcatccatttaattcaaaatgcatttgaattttttgtgagcttttctgttgttgttttgttttgtgtttgttttttgttttttaggcagggtctcactctgtcacccaggctggagtgcagtggcacaattacgactcattgtagcagcctcaaactcctggcctcaagtgattctcccgggctcaagtgatcctccctcctcagcctgctgagtagctgggattacaggcatggaccaccagccccagctaatttttaagtttttctttaaagaaaattatttccatggtagaaatttagaaaatatagataaaaaacaagtaaatgtctaataatcattactattaatactacacaaacataattattagcattttaaatttagcctttcgatttttttaaataaattttcacaaataaataactcctcttttggcataaagttacaaaaatgggattatactttatatactgatatataaaatgatttcaacataccgataatttaggcactttacttatatataaatcaatgccattttgttttctgccctgttttaacttaaaaatataaaatacataagtttccagatgattaaatatttttacaatattcaataatgtctaatactctattcatatacataatttaattaaataaagcactattaattgggcagaattacaatattttcatattatgagtgatactttgatgtcatgatatctattttgtgtctgtccatgattacctccttgggatatttctatagaattaacattacaggatcaaaacgtatacaagtatgtgagaatttttggcgtatatattgcccaattgtctttgctgtagtttgttatcaattttctctcctaatggcagtatctttctccatattctcatcagctaagagaataggtggttccaaagatggtagtcttctgctgtttcttattatctaattttaaaagtttattcccgattaaaaaaaaaagctcatcctatttgcaaatcactcgagaactccaataatcaaaattgtcacatggcatgcatatcatgctataataaagaacctaatatgccagatagcatttcatccacaagtaaagccgcaataatagaaccactgaataataatgacacaatgctgttgggatatttctagatgcattgatataggaggtaggactctcccaatggcttttaataataaacccttttgtttttccaattttcaaatatactctgtagtgcatttactttgttcatgaatctaaatttttttttaatctgagtattttttaaaaagtccttagacacttaaaatgtgtcctacataaaaatgttgttcttaacaaacacaattcaaatggataagagcatgacaaattaagacaaatttcttatcttgtagctagttgaattaaatttacaagtgactacaattatatagctctgaacatgatgaaattgccaaacatgggatcaatacctcaacagtgctttttagttctccttctctgatcaccagaaaaattagtcagccaatgtatctgcaacaaagcatcattttaataactgagctaccaattcagtagacactatatgcagcaagtgatacttaacagtcttagggaatgtatttcattctactcacttctactctttttctaaggctatccctcttaacctgtcatgacataagtacttctaagagtccatgaaaagtatcatgcttacttatattgtccgtgttacaacaatcatattatgccagaaaaatacttttaggttaaataaaaactatttgataaaaaaattatttgaaatgttaaatttctggttattcagtcaggttctaatttctatgccatattaaattatttatttatttatttatttattaatttttgagacagagcctcacgttgtctcccatgctggagtgcagtggcgcagtgtcggttcactgcaacctctgcctcccagattcaagcaactctcatgcctcagcctcacaagtagtttggataacagtggcttgccaccacgcctggctaatttttgtatttttagtacagacggggttactccatgttggccagtctagtctcaaactgctgatctcaggtgatccacctgcctcagcctctgaaagtgctgggattacaggcgtgagccactgttaccagccccatattaaattattatgtgagagcatctctgtccccataagtaggcttgattgccaggatactcaaaagaatagtttctctggcaggaattggaaacatttgtccaactttagatgattcatactctggagaacacagggggttaactctaaatgtttcctttacactgattgttgttttgtcagggcctctttagtgttagaagaaaagtgtcgtatggaaattgctctttaacatttctgaaataaaagtgaaacaggctctttgcatttctgttccagtcactgaagattcttaaaaacacactgaacaaataggctcattcaccaccaataaatagctgtttcgagttcttcagggttcatctttgtatttccttggaactccctcaaaatatccatgggagtcctggctttcttccgagaagctgtaatttgcatgtgcgtttctagagtaatttaaacatcattgatttaatctctcataataggccttattgagtacaataagtttatagtttactctaaatatgaggtatggttatgaagtaataagaagacttcaattttttaaaaaaacaaatataccaaacagctaaatgaggcagcattctaagttttccttttggaaataaatatatacttactccaggaatgctgatattgcacaaaatgttttgggaatttctcttttggaattatatttaaagctaaattataactgatgcattaatcaaacatttttaagcaggtagtattttgggatataggcttgactaagataaaatctggtctcgataagcagagtggggtggctcacgcctataatcttgacacttcgagaggccaaggcaggaggacctcttaagctcaggagtttgagaccagcctgggcaacatagcaagacttcatctctgttaaaaaatatatatatatataaatatatatttatatatataaataatatataatatatatacacttttatatataaatgctatatctatataaatactatatctatataaagtatatatatactatatagtatatataattttatatataaatacatctatatatatataaataaattatatatgttatatataaatactatatatatgtgtgtatatgtattaaaataatataggacaggtgcggtggctcatgcctgtaatcccagcactttgagaggctaaagcaggcagatcacctgaggtcagaagctcaagaccagcctggccaacatggtgaaaccccgtgtctactaaaaatacaaaaattagctgggtgtggtggtgtgcgcctgtaatcccagctacttgggaggctgaggcataagaactgcttgaacctgggaggcagaggttgcagcgaacggagattgtgccattgcactctagcctgggggacagagtgagaatccatctcaataataataataataattaattaataaaaataaaaacatatattaggcatggagacgctcacctgtggtcccaactactcaggaggctgaggtggaaagatcacttgagtccaggaggttgaagctgcagtgagctaaagcctggggatggagcaggaccctttttcaaaaaataaataaataataataaatttaaaaggaagaagaaaagaaaaagaaaaaatactattacatttttgtgtatatattgtctgtttgtcaacccaaagcaatatacccagcttagacatctgtcttgtttatttgatttagtgtgctctgattattgttatttcagaaaaacaagttcatcattcaaaacaatttgctgaggcattccttttggataagagatcctggttaatctgcattaaaaagtcagtcacattaataaagtttaacgcagttcatctagtgtctgaagtttctacaatttggagattaacatttggtgcctcaatgcaatgaccctttcctggttgctcctctgaaagttactgcctgtaggtagagcgtagttgcactgaagagtcatgaaggacatttgaatcaatgtcagtggaaaagaatactgaacatagaatgtctgtcgctcttgttttaaaacatctctgtgagtgacaggcagaatagaggaatgtatagaaattatataatctaattatgtatttaaaacttcttaaactttgaagagtatttgaggagttgaggaaacacctaagctcaaaacttaatttatcagacagtcaaagatattttctcacactgtgttctatactgtcttaggtgtatcacaagctttccttccttatgttctcgacagcatgccggatatgaaagggtcagctaagatagtactatacatttttatgtttattttctcttttacataaggatattgtgtaaggaatcagatttttttccccaatactcacttgttgttatttcttctcatttcttactgctgtgttacgcagaaattgcaaatgttgatattttccattatacaatgttattatgcatcctgtaaaactccactgtactctcatgggatgttcagaatgaataaggctatgaagtttcagtattattatgaaaatagtttctatcttgtggacccctaaaatgctcttggggacccacatacatgctcggatgacagattgaaagccactgttatagatactttactaggaaaaaagtcccttaataactaaatgaatatttttgccgttattcactgatataaatctaaattatggcatagttttatgtgatataatatattttaaagaagtagctttgaaagcagaactgcagctgcataccaaagtttgcaaatcatcttgaaagtccctggatttcgtttgggatggatatgattagaccatttagctccacaaatttaaatcatcaaagaagttttgtgtctgaaaaaaaaaacagaaaaattaattcctttcctctggtttctcatcatgtgactttgaaagtataattataacatgtttgttatatttttgccctggtctactaatttacttcattctaacagaatcatgacactattgtagaacagtttgccactgaatgatttttcaatttttgcttctatgaaattttatctttaactggttagtatttttgtatatatgcattcatgcatctatatagatgaatatttctatattcatatgttgaaatacatggaatccaaaattccaaaatggtagtgtttaattttctgttttatacaggatcaagttactgaaagcacagacttttatcttatttagatgctgggtaagccatcacttcaattcttcctatgtccttaagttcattttgggagcataattaccacataaactgagttggaaagtttgagaaaacaaattgaattgtccttggctatattctccattattcgatttttttcttttcatttctattctgaagttgcctacttagtaagtactaactagattttgttacaacattttattttacataataatttatttggctttttagatctgtgactctgccatattgatgccagatatattctatacaactttgttttgtttgatttcatttttgtttttttgttttgttttgttttgttttttttgagatggagtctcactctgtcgcccaggctggagtgcagtggtgggatctcggctcactgcaagctctgcctcccgggttcacgccattctcctgcctcagcctccggagtagctgggaccacaggggcccatcactacacccggctaatttttttttgtatttttagtagagacggggtttcaccatgttagccaggatggtctcgatctcctgacctcgtgatccgccagcctcggcctcccaaagtgctgggattacaggtgtgagccaccgtgcctggcctgtttgatttcattttaaggataaggcaaaaaaagaaaagtggctaagcaagtggttaaaagctaagaggttaaatatttcctttcaggtaactccaatctaagaacataaataacagaaaacaggagcctttgttctgtaacattttcaagaaccaaaaaaaccatgcttatcaaaattggtataatacaaaagacacatattaatttgataagtaatatatgtcgcatgtcatttatacctaaatgaaaaaggtaataacaaaatatctaatttgtgtccttcatatagtaacagtattttaaactgtgaaccaaaaaaagtcaactacgaatttattgcctccccttatgatcaatatgaatatgcctgcatgtagcatcagaaaatacagccacttattcaataactagaaaactctcaaaggttcagtgattttaataattaatgttgaatcgacacttaatgaaaagtctagtactttctacccatctatttcagagagatgagtagcatgaacatttaaacatgtaaaaaacaactatccaggtttatgtggtgaaaaattacaactataattgtgaagtggaacacaggagcacacaagtaaaggcagaaaagtaaaatgaggaatgcaggcagtctgtagagaatgcaattttatataggatcgtcagagaaattggtaaaatgacactagagcagaaaatgggtttgaatgaaggagcaaatactgaggctaaagaaacattaattttgctttcactaattttcaattgaatagaataattttaataattgcactgattccaagaggcccaccttgcaggaagacaatgtaagtcattagattaattatttagctcagactaaatgtcaagctaatagtaactagtcctctttttctattggtgatgcatgcctttagtcccagctactcaggaggctgacgtgggagggtcgcttgagcccaggaggtcagggctgcagtgagccttgattatgccattgcactttaggctggggcaacagagtgagattttatctcaaaacaattattagaatgaatttagtattatttctatcatttcaattgcaaattgtcagtatcccctgctacgtttctactaatttaccatcgcttcttcaaaaaattgtgttcagagtgctacaatttcagactttgaaatgaatcactataacttttaaaaattagagattttaaaaactggagattgaatatatataaaaaatacaaaatttgacatttaaaacctcattgaacttttaaaaaagccagactcatattaaggcacacacacacacacacacacacacacacacatatatatatgtatgtatgtatatagacttactccccgatgtttgcattatttttgtagaagatagatatcatacatcagattacttagtttttacactgtttcatgagagtccgaaagtaacataagcattatgagtttgttttttatttcctggttagccattataataatttggaatatggagattttcctgtatttcaagtaatgcttaatcatttcacatgatgttgaaagatctcaaaagttcgaagaatgaggttttgctacctaaaggatcatttatctctgatctcttgtggcaatcaacatttgctgaaactattctctcagtggcgctgagatttgaactgctggggataagactagatgcttcctttgggagccttcttggatcacccttcaccttgttgtctgcagtgaatgaattttagtccttgacaatacatagatgctaaatcttttagccaaataatttatctctatagttccacttttaacctgagaagctaatatttccctccaggttaaatactcaattacttgggtttactcagataaactctccaaagtcctttgtcactctaaatatgacctgacaaagctcaaaaacaggaaatgtgaattataaccagcaaacctttcctaaattggcaggcagagatttgtacatataattacagaaacatttggcagctatgtgatattatgcctcaatacccagaaatttcagcaattacactccttctctttagaaatcagaacttgaagccccgtaacccataccgcatgagctgacttcagttaagctcctgaaaaattcaggcttttagccacatgtctcattgaactgtctaaattcatcgagcttagggaactgaattgcagaatctttcaagaacagggttaccgtgtgattcctcatctaactgctgtatctaggcaaagtggacaaggttttagactctcaactaatcctggagtggagtttagcagttatgtagtgcctttttccagagaatcactagcatctttacctgtagcactttattcatctcctttaccttttctgtaaaactctatagacgtaaatcgaggtgacacccatgtggatatgcaatttattccaaagttagtctttctttaagagtccaaaataattaacattgaaaatgtcagcatccttgatactcatgtaggtttaagatagaaagttcaaagagctatggtcataagtcagcaaagctgttaagctgttagataaaactgaatgtaaagtcaaattttatatagtccatgaccctgtttttgaatgacaagacagctgtgcagagaggttaagacacctggctaaaattaaacaggaaggtcaaaactgaggccagaaaccaagactcctgattcttattaaacttcagaatccaaatggagcaaatgactaaacttaccctgtacctccagttatttagctatacatagatgagaagtcagcacttggaggaactggctgaaggtttggcactggagatgtaaggagcaaacattagcttctgattctgttaagtttgaattggaagtctttctgaaattgaggttttagatacactccatatgctatgattctgggcttgctccaagcaactggaagcttttctgaaatacataaatatatcttgggagcttacattaggatatagagaccagtaaaagtaaatgcttcattttaaatgtttaaatatggttaaaaaacacatcttcataaataattgttatagtgactagctgagcttttataatattctaaatgcctagtgtggcacatccctctaaagcatctacattttaaaaatgtccttcacatatataagctaggaaagcaatttctaaaccagaaaaaaataacactcatgcaatatgagcttgaatttgttaaggtgggaggtgagaagggaagaggaatttttgtggtcacaatcaagaacagaaatatgcatacgctctgtgatgaattacttgtaggaaacttagactcctatatattcaatttattttagtttgatagtctcagaactacagatcctcagcttaaatgcagcaagtcttattgtaaagtgtgactcagttaaaatttattgccccagcttcttcttttaaccatatttcagaaccaaattgggccctcaaggactcttattcgtgtctctctatgccaataatgtttacgtttttgtagctgtagacagtgtttgctgttggagcaagcacttgtatcttactaaaatgcttggttacttatacctccatttaataaaaaaattgatgcttaatttataaagttaatttaagttttactagcaaacttaaattaacaggaagttatcctaaaaaagaaaaagaaaaggaaggaagataggaaaaaagaagaaaggagaaaataaaataaaacataaaaaaattccagaagggatattattacatcatcaaaacccaagtattaggagattggctctggtgaacttgacccctgtttttctattagtaaaggtatagcctgtgacaggggtataaaatatccctagaaagttgatttcacttagtcaatataaaatcccacataatttgtagacctcatgtggattactttcccttgatgattgtacaacatttaaagcagtagttcgcaaatggggatgattttgttccccagaagatacttggtattgtctagaggcatttttggctgtcacaactggggagatgctaatgtaatctagatgacagcggcagaagtgctgctagatatcctacaacgcacaggacagccgtcacagcaaagaatgatctcgggtgaaaggtcaacagtgcccttctagagaaaccttgcctacaaggttcccatcatgtgcaaagaatgggagtggggatcaaatgtttctctcaggtactttctattttttcctgtccatattggactgcaagatgcatgggacaatatagactacaccatttgtgaaaaaatgtgcaacagactagccatctgttatcaggcctcctagaatgtgaaacttcaagctatcacaaacataatgcaacaaatcataagtcttgtgtgcctgttaaaatttcattttcatttggtttcaattaaacacttaaattacttaccaccctccaccccaggctctaaatttcaaacatagccactttagttgtgatgttctattttcattttattaagacatcatggagtaaaatcatacatagatgtatatctctagaagataaatatatcagatattttagtcagtatataagtcttacccttgtgtaatttttttaatgttttaacattttacttagcctcattctacaaaggggtaacgtccatgtgtgtagactaaaattattttttaattaattgtatttttaggttggtgaagtagctacaacattaatattgaagcagttgatgtagaatgtgtattgtttatggagtcaaatgaaaatctttatagcattctacgaactctaaaacacataatccatacaacatcctgtgacatatttttgtaattctacagatactctaaaaaagttgatgctcagtgaatcttatactaactatcgttgtggagttcttaaaatgtattaatgtaacaacactattaaatagtagcataagaaaaaagaggacattagaaagcagtatgatttaagaaaataaactattatgtttatattggctcattcacattcacatatattatgaaaaactagatttaactcattatcaactgaaaatgaactgcacctttaaaatgcacaaaattatcagaaatctttagaaaaatctactttcccaggtccacaaaataaatcattattctcacttgacagaacaacgtgcttttttgcaagcaacaaagttttgtaaacagcagaggtagaaaataagacatactttaaactgggggaatacagtggtgaagggggccaggtggttattcctctggacatcccagattaggcaggataataaagcagtagaaagatcacagaggatggaatgaccaactcttgctggaagactcctaaatgttcacccaaagagtttacatttgaccaagatgttcagataagaactttacccagttacagaaaaaaggaaaaaaagcctcccaaaaagaaagaccatgtatttgggaagatagcatgctcacagggggaattcaattaagatcagtgagcatctgttgaatgcctgcactgcacatttgccaagataataccaagataatactacagagagcaagaaaactgctctctgtagtgaatgtgtattgtttatggagaacatagtttcatgtgagttaatactccttatcttcagctttataatctattcagtttttcataagcttatgatttgaaataatggttcgggtttactatttttatttgttgcaattgatatgacaggcactactgctactacttttactagtgtagaacataaagagtttgaaactacaatgaagaatttaaagagtttatgagaatgtatgtatctatcttttcttaaattccataataattttgctcgtttgaaatttcacctgtagtttgatttttttttttacttcaaattaaatgtgtacaatgttggtttattattcttttatttttaaagccagagcaatttgatattatttgcttgccatagaataagataatttttaaaaatttctttttatctgatttagtattaattgctaaatttgaattgtactttgtagttaacagtgagctttcccttgtagcatcttttaataaatttgttatattgacagtaaatgtaacaattaaagggaattgaaaggaaggaacaggcataacatttattgaatgctctattaaggagcagacactttttaaatggctttatatatattataaattcatgacaaatgacaaaattttctaaataataatatataattctcaatcatctttattctcttcctgtttccctcaatgatggatggcatcatttacaatatggttagatagaaaagagataagagtcttgaatctgtgattatttcattattggagctaaactaatccgtctaataagctacctattagcagataatggaaattctctaatgaaaaggctaaatgtttcatgaatattgaatacattctgggctaaacagctaactcttggccaggtgcgatggctcacacctgtgtaacaccagcactttggtaggtggaggtgggaaaatgacttgaggccaagagttagagactagcctgaccaacatggcaaaaccttgtctctatcaaaaatccaaatattagccaggcttggtggcgcacacctctaatcccagctactaaggaggctgaggcacaagaattgcttgagcctgagagggggaggttgcagtgagccgagaacgcactgcaccaccgcattccagacctaactgtctatggacttcaacactaaaattgggcaaagcaaatcacttattcacatcttcttctaaagaaagagtttaaattagccccagctcttcttttagactgagttgtttggatatcatatataaaaatataaattaagagtttttcattaaaaataaaaataaatatgtttacttctaagtatataagctcaattaactgtgacctgggacagaatctggccagcgaggaaaagaactggtacaccaaaagttgatcaatagtagtatctggataaattacggaaacatttaaagcactgcaccctggtttcattgttgaactgattgaatgccacttaatttttgagtgtttgtaataacatgtccaaaataaaatgaaaataaatgagattgccccacttccttatgctttcccacaagggcagcaactgaacccttgatatagttaagagacaaaaaggaaaagtgtaaatcaaaaacctgaatgacacaagtgaaaagaccatacctacatttccaaagctagcaaaacttgtagcaagaggcctttgccatttcacaggtatctactgcacaatgtggccaagatacttttccaaggtaccacagtgagctaagagccagaatattttgttaaaaattagtacgaaggtaaagatagtataaaggtcacctgatcagcaagtatgttacattgaaaggtttaaagttgtcattctaacaataatatgtgtgtgtgtgtgtgcaggctacaacaattacaaaacacaaccagaagagcagaattgaaaatttaagtttttcttattaaaataaattactatacatttttccaaacatgcatcccatttgtttaaattttaagcattttaataagatttacacaggttacacaaatagaccacatgtaattgggaaatattctggaaataatttgcttgaatctgtaaccatgtatttcattagagaacatactgtataagtcccaggcaagttaagagattcaggtgagtgaagctttccttgaagatatgatcatgcgaccacagcagatacctctccaacattattatgtctgtatttacaacagagcaaaagaggattctccttccaagcttaagcagaaatatggctctgttcttcctaaaaatgatcacctttcagtatatcattattttaagaaattctattaatctcaatgctcttctctctggaaaatggtgaagaaacacttaaaatgaaacaactcttctgtgtttctttttaaccctgattgaattaaccaaataaatacacttctctttcatggctgtcatcaacctattgtttttttcttatgactctattttaatttcaactagagaccatggtaaggcaacaaatatctgggcctaatattttctaaataggtacaaagttttcagcatagaaagggcttttttttttcttttttcttttttttagtgccatttaagtacacttcacaatttcagtattactgaaagtatactgacatgatcctttcagtataagtatacttatataccttcagtaatactgaaagtatacttatacgctttcagtaatttggttctggaaaaagagaagtagcaaaggcagttagaaaaatgacaagtgtctataacagacctaagatatttaattgagatttttaagatactgtacctcccttgtcctatgaatacagctctgtttgacttttgttaattctctgagttcttaagaaggagaaagtaggcccaatgattccatttggcatcctgagtagattctgttcaatgccacatgtctaagtccacttttgtcgatgtcaaggggtagtatttgaaattttgaattataaaaacataaacttgatctaggcatatgtagatgagtgctttgggagttttagtgcacgttgcacactgtagtttatctccctaacttccgaggctatcttttctctggctccggtctctccaatttcatttgttttacttcatcagtagaaactgtcaactattcttcacctggtagcttcttaggaaggttgcgctcactgtgtgtctttgcaggcttattcttcctgctgatggtgtttttccatttcctcaattctctgcactgtttcttgcattcttcatgactgtgtaagctctaccttttcaaagagcttctggcagtactctccctgaacagctcatttgtgccaaaacaccaaggagaagtgctcagttttactgagttagttccaatcttatcactctcctagccaggataaagtttcccaagtgcatctgtgattaaataaaaatttgacattttagcttcctcttccattatatttcttcacacaggaaactgttcttctagaacatacagttttctcctctgtgctttgatttatgccatttgctcagaatatgagagtattgagctaacatttattgagtccttactatgtcctaggaagaagactaaatattttactgaaatttgtcgtttagtcccacataaatactctgaaccaggactattacattctcaataacagatgaggacagtcctgcacaacaaggcttagaaacttgtcccctaaattgctaatccatttgtgtaaagcactatattgcccccttgagcatcacttcaaatccagtggcatgctatgaggtccgatagaaatcggtcacattttgacgaacacggcttaagattttgaggatgtgagttctttctttgaaatatccatcccttttttcttatatcaaatattgtacttatctttcaagtgacttcacttgaaattgaggtcacttaattcataagtgccctcctcagtctctctagtgagaatcttggctccacgttccacattacggtggctttcactactgtctttctactcagggtaagttccatggaccagcatcacatggagattgttggaaatgcagacactggctacacactcaacctcctgaatcaaaattttcattttactgggagtaagctgtatatgatttatatgcattataaagtttgaaaagcaatgtgctagatacctatttcgttctgtatctagtttttcagagtaactcattattactcctgtttgcctgacacttacgaaacaaaagagccagtatgttatttatcagtttcacccaaattaactagcataatacttcctatatggttgacaatcagtacatctttattaaatgtatttattgaactaagagcaaattccatagacattacacttttatatctcccataacttataaaagcaatattattttcctctaaattataagttctgggaatgtaattattatgtctatctaatttatatggtgcttgcctactatccagaagacacttcaatgactaatgatgaagcacacagtaaattaatcaagatgattattgtgttgaagagagttttttaaaatataattttattttgagtttatttaggtaacaaacacctgtaagtacttatgtgccagggagtggtctaagttctttacaaatactgacttattcacattctgaacttcgattgcttggtcaagcataaatctaggttaaatcaataaaagttgatttgtgatacctcttttaattctaatacatgtcatgtcacatctgcttcaggttgttttgttgcagatgattaattaacctgccatagttgatataaaatgtcaatatttaagcaattttcttttttatatataatttcaaaatccttccaaattatttggaagtaaaatttgctgtaaatggtatgctacttctgcttggtattgaaatagaataacatcaaaatgtttcacagaaatgcatattccatttcagaacagaaatactatgagaaattctgtccggtttcagattatgttatgtatattatatgttctatgcattgctgatttatgtagacatgattttatattcaaagggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaagtatttgtggtctatgagttatgagttcagatgaaaagatcaagctgtgcaaggaagtggaacataatgtaactgggtggctcctggtttataacactgaaataaaatatttagcagcaatgaaactgtttccaagtcttgcaaggatattatattaattgaattgttcttacagatttacatatttccctcaagcaagggtttagaaataagacaaaagaaacatttgtagtgaaaacgtaatgaaaaaagtgaccaataagataacctctagattctaatgcacattgaagtttgaaagtcactgctttacaccattgaaaagtactaatgaactaatagttacttaattttacagcacttaggattttacaaaaaaaattactataatttggaaggcaccatttgaactgcagtataactaaaacctgtatagtaattttgtccatattcattcatatatgttttccatagagaactatataaccaaataataatttctttataacaccaaatttgctctatcatttaacatttctttttattttaacccaaaaaggatctttacatactctttcctaaatttatgttatttcaatcttcctttatataatattttaggcatacataacgtcttatttatttgatcagttgttatccttttaggcaactaaaaatgagaagttttcccacttacctttaaaataagcatatttgtgagccccgcccatgaaaacgtaaactaagtgacacttcctgaaaacttcctggttcctgaaaactttgcttctcacacaggtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggtgacacattcaatttgttatctggcattcactctgaaatttgtgtttgctatctccaagatgttaatttttttagcccacccccaaaatgcattatttgaagcttgtattccaccatattagagagatgtatttcccctttcttttttaatctttagaactaattctcgtcctccttaatagtaatgatgaaattctgagatattttttaacatctatcttgactctacattcaggcttgtttaagtctttgggaaataggaatactggaggggtgcggtggctcgtgcctgtaatccaagcactttggtggatcacttgaggtcaggagttcgagaccagcctggccaacatagtgaaatgccgtttctactaaaaatacaaaaattagcctggtgtggtggcaggcacctgtaatcctagctactcgggaggctgaggcaggagaatctgtgaacctgggaggcagaggttgcaacgagctgatatcatgccactgcactccagcctggtcaacagagcgagactctctctctaaataaataaatatactgaacacatacttcttttcacccttcatgaataaagaagtcctgattcatctttcattcaaaataaagaaaaagaaattatccaaaatattgcactggctagcaaaatgcaaattttccccagttaattaaacaaatatttgtctagtctatattgcgtatcaattactttgctagacaccattgaagataaaactaagagtaagataaagccagtgtccctggacaacaacacaaatgttaatactctgcagctgtaatgcaatcctggatgcacaaagtctatttaattttatgcatattcttttaggttaagaatcactgagttctctcagtggttagaacaatgtaaattaaagtgtatctacaaagtacagtggaaaaaagaaggaagaagagatgaattttgtcaggggccatataagaagaaaataaatattaatatatttggtgcctctcagagtaattaaaggcaaagatatcttgtttaataattttgattctcattgtaagcataagaaaaaaaggttcttttacattttgataatgcattctcttacaggcttttaatttttctctctgatttatcacatgagttagtacatgttttatacttttgaaacattcctcttgacaactatagagagaagcatttcagacctatttgggacctctagctatgtgcctactcaatggcttggacttgtgagttcaatagtatcttgattggtacaatggagttttatcagtaacgatgacttgtgggtcattctgccttctttgcataaccagttgcttctcaatatcgcttctcaactgtgttagttttgggtctcaataatagtatcccgccctgttgtttccattgctacaaagcttagtgactaaagctggcgttcaatgcatgggaaattccttgcattttgtcttaagttatctgtttgaagatcaagcagggcgtgtgtgtgtgtgtgtgtgtgtgtgtttgtgtgtgtgtgtgttggtgagtgaatatgtaggtacattacaagtttgattaaccatgccttagtatcatatttttgtgaaaaaaatcaatcatatttaaaacaatattttaagatgtctaaaatcaatgcccctgaaatccacagggaataaaatagcaaaattttaacatataaacgttttttatccattcttctgtcagtggatacctatgttgatttcatatcttggctattgtgaataatgctgcaatgaacatgggaatatagatatctctttgaaatactgacttcatttcctttggctatatacccagagtgggattgctggatcatatggtgattctatttttagttttttgtggaacctccatacatttttccatatggctgttccaatttacattcccttacatgccaatgttccctttctccacatcttcactaacagttgttatcttttgactttttgataatagccatcctaacaagtgtgaggttctagctcattgtggttttgattttcatttctctaatgactagcgatgttgagtacctttacataaacctgttggccatttgtcttcctcagaaaaaaatgtctattcaggtcctttgcccatttttaataggggtattattatttttgctatcaaattctatgagttccttatatattttggatattagccacctatgagatatattgactgtaaatattttctcttcttctgtggattgcctttcattttcttgttttctttactgtgcagaaaatttttaatttgatataatccctcctgtttaatttggcttttgttcctatgattttggtgtcatctctacaaaattgttaccaagaccagtgtcatagagctttcttcctgtatttcctgctagaagctttacagtattaggtcttcagtttatccattttgtgttgattatattaaatgcacattacctgttttttacataatagtttaataagttaagtaggagaatcataaacaagatcttaatatcagtatataagaatcatagattatttattgataataacacttagtaggaatcactatgattgaatttagtaataagtccttaaataaaactacccataacttattccataaggataaatatctatcccaaacttcacagagactgtatagactcttagaaattcacctgacagtttaacaactaacaggataacaaacctgtcctttcctgggccatatggtcctcattctgtaccctgaaggcatttattttgatctttacagcatagatagtaatcacagaaaaaaaaagactttacctatcataaaaacattcaaaccattttcaaagctaactcatgtaatgtaatgtaatgtaggggtatctaataccagtttcacagagaaaagtagtcttactatcagatcataatatgtgaggctatgtcctagcatccaaattttaacatactttcataattcacttttccactcttattgaaatatatcaaatactttttcttatatatttttctttaatacatgaactaatttgatgtattttgtcataaaacataattttagaaaaaaatcaatattttctatgaaaagacaaccatctcaatgtacagaatataaacatttgggcaattatatttatatttttacttattaccattaaaatgcacgatgggttagattttgtcataatacatttatttttaacaacctcacattactatatgcaactatgtcaagaagtttttttctctttagaaaatttgctttcctacttttgacaatgattatttcatccttttcataactgattaaaatgacctccttctttaatttttagtgatgtccttgccaaatgctttattgagaaaataagccattagatgggaacttcccacagcaaaacagaaatgtagtggcacctgcacctacccatatcgtccttctttcctctaattataaaaggcagtgtccctctatttgtcagaggctaatcctctactcttcctctctccctgtctccctctctctcttctgcatatccaggctctttttttctgtaggatcattgccacaaacagatgttctattatattctttctcattatcttattcttatcaccaggggaacctattacacatacaaatatccaggtctatcccaagaatctccaggaaaagagaatggagtttggatgttttataaaaatgccaggtgatttttttctcctctggaaaatttaggtgatattgcttgtcaatattacccctgctggccccacatctctgccaactacttccctacttctctaacactcttcacagccaaacttctcaaataatggactcacagacataaagtcaatattctgaaaatttatcaattttctccccctagcctgatccttccactgcctaattaattgcatacaccagcagctacccattcacctaaccaggaattagagcaactcttggtacctctttcttcccctctacactgtgatcatctggatcaatgagatctatctctatcccttttcactgaaaacactctcctcatggctgtttcgtcttctgacctggaccactgcaataggctcctaacttgtcccctgctttgattgctttcaaactccaaacattttttttgcacagcctccagaatcttcttatcaaaacatatatgatatagtttcagtcacctgtttataatcaatattgaattcacgttacacttataaaaaaatctccttttggttgtttaaaaagccctgctgactgggtggagtgactcaaaactgcaataccagctattcaggagactggggctggaggataacttgtggccaggagttggagaccagtttgggtgttatagcaagacccccatccctacaaatttttttttaaatgggccaggcatggtggtgtttgccagtggtcctagctactcaggaggctgtagcagaaggattgcttaagtccaggagtttgaggttacagtgagcaatggtaacaacactgcactcagcctgggtgacagagcaagacactgtctcttgaaaaaaattataaattaattaaaaaagaaaattttgaaaagtcttgcttctccaatgttattatcttattcaaataaattttattcgaaaactatttttatataatacaatgagatgactatagtcaataataccttaattgtgtattttaaaataaatggtgttttctgccactcttgtaaacaacagacaagtacagaccagaggaaggaaataagtaaatggccgtgatgggcgataaaggaatagctgcgaaagagtctgaggagctgatgtttgagacctgcaggaagggaatgagccagctgtgtaacctcctcctcaccaaaaagaatattcttggcacaggattaaaaaatgcaaaagtcttgagatgagaaagggtttggagagttctaggaagtggcagagaataatatgactgaagggagtctgtcatgaacctaaggaggtaaacagaagccagagcacttgaggctacacaggccatggtgaggactttgaaatatttttcaaatgcatgaggaattcattaggcatctgaaccagagaagtaagatgatttgatttatatgactgctttgtagagggaggagcaaaagtatgaggaggtgggggtcattttaacctttcgacttgtgccaccttcatctaaacaatactctaacctcagtggctacttctagttccttcagaaaacaaaagcatttcagaagattgtagcacatgctgtttgccttgtctcagattctcctttgcacctttcttccttaaggaagcaacttacacatcatgtatgtgttgactcattctgtggcagcaccagtgaaataaagtttaacatcattattcttttacagagcaccatattctcgttcttcatcactattttaattctgttttctgtgattgtgtctgtgtattctttttaactatccattttctcaataaactctaagccctgtgagagcacacaccatgcttctctcgtattaccagtgcagattgataatgggtgctctgtaaatgtctcctaaatacctaataaatatgtgctgacatcattagtaaatttacatttcaaaagatgcaatttatagaaaaaattccagtgtttttctgctctctgaacagatttttttaatagacattgatcatatggtaaaagcctagacctgttctcctaagcaaaattctgcatgtgtacctttctgtcaactcaactccagaaatacactcctaaaaatttaataggagacttcaaaactgaattcgtggctggtacaaagcattcaagtttctgaatggtgtagttattcagatcagtgcatagaactgtgtttatacacgtaccctgtagtgtcttttaagaaaaacaacatcattctgatagaaatgatgtttcttcagtctttctggatttagtacattttatggtcaaattttatttttttcttggtggctaagtaccttttgaaactaattgtttgaatttaaaaacgttgttgcatataccgcaatagaagtctttttataatgcatcatttcacttttcagccttcattagagttgatgatttatagcagtaccattctcaaagaatcttccgcttagagtgtctccatgaatatcgtcactggaagtggggaaggtggaaaagctgatggtcagggtgggccagatcaaacaattacttagatgctgcaaagaatcataataagggaaggacagttacattaaactttgtgttatgcttgttccctagtaattgattgctttttctaaaagtagagtaaatcagaggagatgtgagggttttaagttttgatagtacatcagtacaaggctacagatgtttattcaacaataaccgtgtgtgagacattatgttaggtcctgtgatgattatataggtaccagatgtagcttccatcctcaacagcttacgtttaaatgtggaagaaaaaagaatatttagaacactataatacccctcagaacatgtaattattagagcaaaaataaaaggagttcgggaatcccgaggggaggtgagtttacttttatatttggagttttctggtatttgtatgcaaaagggacttttggatagtggatgaaattgaaatttctacaggtaggtaacaggaaaacaggctgggggaacactacagaaaagggaagacatgcaaataggtaggatacttccaaatcacatcgcataatacggttttgctagactataggataaaaaaaggaaattatggggaaaaagcctgatagatcagggatcctcagcccccgtgccatggactgcttccaggccatggcctgttacgaaccaggtggcaaagcagaaggcaaacggcgggctggtgagcattaccgcctgagctctacttactgcagatcagcaggggcattagattatcataggagagcaaaccctgttgtgaaccgcacacacgaggagtctaggttatgcgctcctcatgataatctaatgcctgatgatctgaggcagaacagtttcatactgaaaccatcccccaccacacccccattcgtggaaaaattgtcttccatgaaactggcccctggtgccaaacaggttggggaccgctgcgatagatgattcgtcaggtgatggaagactaaatgtcatttctagacatttgggcttttatccataaggaaaggggagacactgaagttactgaagtgatatgttgcactgtgtttagggaatagttctttggcagctacttctaaaaagggctggagatgaagggattcatacgagagaattaagctttcaatagtctaagaaaaggatctgctatgctagagcagggaaagtagacagtgtgtgaattcaatatgttttattaaagtgagttctataggacatagtgactgagatgtgcagagtgacagagaaagtatcagagaatacttccaggttctgaatgtggagcctttgagatcagccttctcattgacagtggtaggaagaacagaaggaagaacaggtctgccatgcagataagcattcttggcaacagtcaagaaactaatttaaatgtttgaatgcctcctgtttccattgtatgtaacaaggtgtagtggcagccaatccagattttaggcaccttgtaagggggctgtggagccaatcagtgacaggaaatggcaatacaagaaggaaaacaaatacgaaacattcactaatatctcagaatattaactcactacgttgactgccaccaagagagaaagaaaattccctttattttgagctttggagagcagtgccagttatatcacagaagaatgtgaaatggtaggtagaaacgaggaacaatcagggtgataggatgaggtttagactactgcagaaaaccacagtgcaaggcatttccaaaaagtagattcaaacggtattaacaaaagctgaaaaagggaaagaaaaacaaaaactgagggaatagacttccagttaaataatagaaggatttataatccattgggtatatacccagtaatgggattgctgggtcaaatggtatttctggttctatgtctttgtggaatcgccacactctcttctataatggttgaactaatttacacgcccaccaacagtgtaaaagcattcctatttctctgcatcttcgctggcatctgttgtttctagactttttaatgatcgccattctaactggcgtgcacacgtatgtttgttgcaggactatttacaatagcaaaaacttggaaccaacccaaatgcccatcaatgatagactgaataaagaaaacgtagcacatatacaccatggaatactatgcagccataaaaagaatgagttcatgtcctttgcagggacgtggatgaagctggagaccatcattctcagcaaactaacacaggaacagaaaaccaaacactgcatgttctcactcataagtgggagttgaacaatgagaacgcatggactcagggagaggaacatcacacaccagggcctattggagggtgaagggaaagggaaaggatagcattctgacaaatacctaatgcatgtggagcttaaaacctagatgatgtgttgataggtgcagcaaaccaccaagtcacatgtatacctatgtaacaaacctgcaggttcaacacatgtaccccagaacttaaggtaaaattttaaaaaagatagaaggaacattgaggtattaagaaaactattctgaattttggaataatatatattacattgtgagagacctaattataaaattggataatgaaaaggcaaggcaaaacaagaagatgtgcataaaagaatgaaaacaaaagaagctctcctctctttttttataagaatcaaagaaatgtttcttctttcttctctttctcttcctctttttcttactctttctttctttctttctctttctttcttcccttctttctctccttccttctctccttccttctctccttccttccttccttccttccttccttccttcgttccttcctttcttcctttctttctttcttgacagtgtttcactcttgtcgcccgggctggcatgcaatggtgccatcctccgcctcctgggttcaggcgattctcctgcctcagcctcctgagtatctggaattataggcactccccaccatgcctgactaatgtttgtattcttagtggagatggggtttcaccgtgttgaccaggctggtctcgaactcctgacctcaggtgatccacttgccttggcctttcaaattgctgagaattcaggcttaagccaccacatccagcccaaagggatgttttttaaagattgttcttgatagaaaatgccaccatgaaaataaatagaaaatagtcttaaaataaaaatattctttaacttcccaacacattgttttgtacatataagagaaatacacatttattttttaaaaacatattttgaaagattataatataacttctagatttaaataaatttattcacttattttataactgaagctaaattaaaaattgactaataacagaaaaatgagaatgtgtttctattcaagtagtaagataccctttttatttttgaagatatgagatttttattattgacaatattaattttgaagagatgtatgtgtgtgcatatgtgtgtaaaatgaaatagagaaataatttcttcttaagttcacagaatttccactagccaggtattgaattcttctatactgttgtaaattgataaaattcaaattcttgacacaaaaaaattagataatacattcaaaatatttagaacgaggttttaaatggaaggcaacacaattcatgacacagacttaagcaatatatttaataatatttagaacaaggttctgcagacccaattatatttagttaatttaattgaaatgtttttaaatatattgtttcattgcattgatcactaactttgaagggatttatttttattaacttgcagcatagaaaggagtaaaaataaacaatactcatattttccccagttaatgaaaataaacaagtattagtaaaaagcttctgatctctaagagtacataatagaattctttttgagaataactgctgttttgacaaataccatatccttcaagacaaatcgaacaaccaaaagacaatctgcctttatttctcaaaatgactttgacctcaaattctgaaactgacagggtgactttgctcagtgaataaatatgatacagaaccttttagagggaatcgaatatgccgaatacccaagtgatctctctgtctctctttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttattcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgagaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttggagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcctgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagactccgtgggcgtaggaccctccgagccaggtgtgggatatagtcttgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttatgcgtcgctcacgctgggagctgtagaccggagctgttcctattcggccatcttggctcctccctcctgtctctcttttttaatcttaaaatcaaaacagctaattttaccacacggaggaattaaaccaggtgtaacggctataacttcaaagatttttgtccttaaggcctagagataattaaaataaacacaatgactttatttctccttaatgtgtcatttatgtactaggttcctgttgggaactgtatatattcaaaattatttttagttactgatgaaaaattaaattcattttatcgtatctggatttttaattttagtgataaagatcaaggtcatcggcaatcaacattaaaataaattggcaaatataagattttccccctgaaatacattggggaaacatttgaaattttaaaaaacagttataaaatgtacggaaaaaatatattactattctcaaacaataataaattcagatacaattattagtattttggctttaaaaagttgctttttagatttaatgtatttcctgaaactattcacaacaaataaaaaataattataatgttacagtatgcatctccaatgttattacctccttgtagacataataggcatatacttattcattcaagaaatgtgtattagttattatttttgatatttgaggagtaaatctctttgtaatcaaaaggagtctattaagtgagaaatggataactagagattcagaattctaaggtagcattgaaataagattattacccgaagatattcctgggattggcagttgtttattgagctttttccccagtatctggtgctaatttttatgcacctatttacagctaaaataggaattgatgggaagaaaatatatatgtacctctctaatgcaacagtataaaacccatgaaagaataattcacaaatcttaatagaaagagagagaaagaaagggaagaaagttatttttcacttcccctgagcaaatatgtaatttccatgatttctttttaatgactgcggtctgtagccagtaggtactgatttatgaaaagctgtaaaagatcaggtggagctctgtaggacatcgtttacagctgcatggattgaaacctatctaatttgtctagtaaaagtgtgagctcacggtgcacatcacccagcctataaatttccccttcagaccaatgtctggggctgggtctgaaaaaacgccaatgcctgcagctgctcaaaggcccagattcccttggtgcgcatgaagagacatcacaggctcttcacagtgagagacaaattcctatccattgataaactctccagatgtcctctctgaggaggaaaggaaccaatttttatttgaaatccccagagaaatcctggaagtggaaaaatgatactttgcagggctagttattctgaggtcattggcattaaaattaggtcatttttttttgtcttggatgcactttgatccaagtcataaacagacaaactcagttggggtcactaatccttaatccacacgtcctgttctatttcaatttgtttatactaattttctctaaactcttgttgagtctggctaaagtgttgagtgtaaaagtacaaactattctgaactgagaagaaagaattctgcattttgctattaggcacacttcataaatattctgaataaatgtcctggggtttgattcttcatacccacaaacccataaataaaaaagtattactattcatgggactaaaacttgacataagattctgtgctccagctactgtagacagagaaactgtggcgtgtgcgcgcgcatgcctgtagatagtttaatgtcttgtctcattctaggtttcacatgatttttcttctaaaatcttctcacacctgatttaatgctattcttatcaattttttagtggttcaatgacttatccaatgagtctaatgtaatgtctaatgcttgctagtgacaaagactatttcactcatgataactatgctgaaacaacccatgaatattgtgtacattttggtgtatatctgtaattactcaagttcttaggaaaagaataaaaatacaaaattttcaattataaaaataagctgtttttcttcctaagatgagtaatttaaaaaatcataaagtcgtttgcatatatgtttcagaagaagataacttatgaaatgttatattgatattttatagttttcctgatattgctaaaggaaaaaattaatatttatataatatggcccaatccttttttagataatctctgagagttagtaaaactaaactatatcagagaaatagaaattataaactccataattaagattttcaatttataatttgaacttgtgaagtaaaaaggattgaggtaattgagtttagtctagtggacagaagtttgaagaatccttccctttcaacttccctccactacacaaatgaccatcacagagaggggactattaatctatattttccacagagtatgtaaatagagtcagaaccaatgttgcaatttttttttcctgaaactcagggttaaaactgcactaaaatgtgaccatttttatcaaatacgtttcatgcatcgctgtaaaaatccagatagtgaattcacaaacttctcatatgttccaagtaatagcatgtaggtgtagggcacgatctaaaattatcctggctcacgaatcaactttacacttgagcaggtcttttgtacataagagagtaagttgaagaatatcaccagaagtggtataaacctctcaattaaaagacctatttaagtgtgcgcagagctggcacagatttgcttcatagattttctcatttagaacaggagcttttaccacatatcctagatggtaatcaatgattgctactcatatgtaaaacattatacagttttatttcatgtatattgttcattttgctatttcatgctatttctaaagatattgaaattagccccttagagacctaaatttatgtctaaaataaggataaatgcatgtcgatatattatttgttttggtgtcttctcaccacaaattctaaactttgaatttaaacacttcaaatgacagacttcacttagactaatctttcatttcaagtatataagaaaaatatgaagttctagttttaatactcctaattttggagatttttattgaaagattctgaagaactaaaacggcaaaaaatcaaaatataccctcttaattattaaataaagattaaattatatataaagttttaacattaatactatattttattacaataatgaaaaaaatcacagacagcagaatagcacttctgttttcaagcatttgcagtggaatgattgtgaagttgtaaaagttactgactattctaatgaagcccctaataatggctacttttcagggttgttatactattatgtacataatattatatatgactaaatttctagttacttaaaatggtggttaacaagatcattgcattcccagcattatatataaactgatatttactctgctattttctttttgaagttttcagaagtttaaccatttcaccatttacataagaataatgaacagctaacacatagtgcttattatgagccagcactgttctaagtgcttcccacatatgctcatttaatcttcatttgtgtgaaattgatatcctcaccatcatccccattttacagatgaggaaacagacaagaaattcaccaaggtcacacaaatagtatgtggtatacctgggattcaacccaggccttacggttccagtatctgtgcactaaacttcagggcatataaacatcgaatatgccacatgatggaatcataaatcatttaagaaaaaacaggggaaatgcaatatgaacaaagttttacctaaatggcacagtgtaccagtcaagaatgtggactgtggtatagaataatgtgggtctaaaggccagctctgcctcttttgcctgaggaaacttagcttcgtaacttaatgtgatttagtttcagcttctttatctatctcagaggatagcatcagtgcctaacaggtactgtaaggattaaggtccttcatgtctgtgtaatattcttagcatgatgcctgccacattgagtgcacatgaacgtttgatataatatgaaaacaagggccttaaaaacttatttctgtcattgttattattcatccaaaactaaaggcttttataactaccttgtgcccaagctcccttccttaggagaaaagaagagagaagtcaatatattgttcacctagtgactggctccagtcttataagtcaaaggacaattaaagaggccactaagagctgaagaaaaaaaaaaacacaccaaagacatttcaccaacagtctgcttcttttgcctcttcagggaggcaaacattgtctcattcatttcctttatgcctcttctgttccattgatttaccaggtcttgcaggtggttatagatagatgtttaggcctgtatttatataaaaaaatcctagaaggaagtcctttttctttctctctttctttttgagacggagtttcgctcctgttgcccaggctggagtgcaatggcatgaactcggctcaccgcaaccttcgcctcccaggttcaagcgattctcctgcttcagcgtcccgagtagctgggattacaggcatgtgccaccatggctaatttggtatttttagtagagatggagtttctccatgttggtgaggttggtctcgaactcctgacctcaggtgacccgccggcctcaacctcccaaagtgctgggattacaggagtgagccactgcgcccggccctttttcttaaagctgattgtattgtgcaatataaatcacaattacaatccctctctgagtctctgtgtgtgtgtgtgtatgtgtgtgtgtatatatataaaatattatgtatatatcatgtgtatataaacacattacatatataatgtatatatcatgaataatgtgttgcatatatatatcatgaacttcatttggtgtcaagtatgcaagaatgttttttcttatcagtcatctacttttttctattattttttatttttaatgacatgcagcattatttaactctgtattgagtttatgtcctgctgtgagtgtagcctagattgttcaagccattctttagacagcaacctgtgcaatgtcaaacaaacaaacaaacatccagtgggaaatacttaaaatattgaaactgaatccatcatcaaagcagacagcaaagaattcagtgtgtcctgcctactgtaaccgtatcctaaattactaccatttttgctagtgattaaattcaatgataataaaatatgtatggatatatttatgtctttcactggaaaattttcagtgatttaaaagcatttgtggatggagaaggggagaacttagacaagatgattacacggcgttcctccaagctgccagcttgaacagatgaagctttcatggcagataaattccacaaatgaaaggaacaccatatgaagtctggaagttcctgccgatgttagtgtcaaattttgacacacagcaactctgctgactcctgatctgtctccctttggtgttttttttcttgcaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagagtaagaaaaaaaaattcattaagaagaatgaaggattcttttgaactttcttggcttgacatgaaagatttgtaacatcttggcttgacatgttacaaatattagtggtagatctgaggtactgactaccgcctggaactgctaatcagggccctgggtctccttgtggcccacagcttctggattgatacatattgatgtgtcttcctctctcaagatagggcccaggatcggtgtctttagatatgaccttcagatcaaccaacagattcacacccataaccacactgcagactcaagcccctaatttaaaacataagcagacatagattgatgattattatatttctgcattttgtgatttttctgttatttttactaaagcttaacatctgtgaatcaggaaaattgagagccaagtagataatgtggtatacaaggaaacatattaaagtctaaaactggttttcatagttgctaaataaacataacaacatgtattcatcattgtctaccctgtaaaggatatcatgctagaaaatgaagttataattaggtttaagatagaatttttgggttttcctcaaaaggcttattgccagatgagaaagaaaaaatatgcgtcataatattaatattaattgatagctttatgtgttaaaaaccaataataatcaagtataatatgctgtattttgtggacaatcatctttgggtaacaggaatcttttgatatgagaaacacatggactcaaggaaaggtggtatataaagaatcaagtgaatccagtgaatagtcaaaaatttggttcttattcacaaagtagagtgtttgggaattgataaattaagagttggaagtcacattcttcatctcactgtgattgagaaccaatttacttcacttcctaatgtgactacataattttttctttttctgcacagtgacattttctggattcccatgcgcatagctaaaaactggctttctaaactcttggtcatatagccttatagtgccattcaactgaccagggtccaactcccttaatctaagttaccaggagagaaagtaggactggctcagtcccacttgtacattggcacctccaaagtcatatgtttactagtatctagtcatttatcttcaaaagaagtagaatgaggtagtatgaacttggctctaggggccttttcctgaagataagatggagaactgtcccaaagaaagaagtgtatactggatagatacaccaaaagttgtccagcatgttgtcgcttgcatggtctattgggaaactgttcatctttgtgtcagtctttctttgatctttgttaaattaaataaaccctttagtcccccaagtttaagtattatcatctcccactaatatttaaatatttaaatattgttgaatatataaagactttcattgccaccctgtcaatcattcaacatcactgtgaaaaataacagattagatgccagaaaagaacatgccatgtaattaatagatataagtgcccaacaaacaaataaataagtttataatttatggtgtaacattacaatcagaaagacataaagccaaagaaggacttacaggaacagtttacgattattgaagaagaggacttgttctaaaaaaataaacttaccctagtcaatttaacatgcaccagcattcttgttcaaagtggaatgtggtgtttattgaatagacttctgacccaatcgacagtacacttgggtttctgtggtacttattttgatcagatacagtctcaggatatagtcatgtgtttaaatatttttataaattcttattttagtaatataaacagttagggttatgatacacaaaacacctgctgtagagcacagaagcatagcgaaaagcaaacacaaagttgaacatgtccacatcactgccagattttcaaaggcaaagttatgcaaatgtttactctcaataaaatatcaacactcaaaacttttagatattgaaacactatattgaaatgtatgaggcagaacactgttgataagattaactgctagtttgcaattcaaatattgtcagccattataagctatgaatgtgataagaaagctatttgctttaaaaaagtgaatgacagcatttgtcatactttccaagttagcgacattacttatgtcagcaataccatgttggacgtcaaactctttttggctgattggaatatttttacttaattgttattattatttgaacaacctgtgaatatacattcaagatgaaaactgacttttcctgaaagacagctttttcaggtttgtcctgcacactgagtcaggtggtatggatatgtccatattgcactccccacaatattccttcttctgtcctttctcctcaattcagggacaatataggattaacacctttgccctaacactccttcttgaaaggagctgcttttttccttgagtcttcatagtgtcatgcacctcatgctcctaatttatattacaaaaagagaatttattaaaagtctttaacatactaataatttgggtaaatataatgaggcaacattttcagcataaatgctgtaaaatattgagctagatattttagctttctttcgggttcctggcttattgtttgaatttgattgctttcagtctgtattttctttgtgccatccagactcaattcagaaatgatttgctcgaccaaataactgtggagatcctcctagaatagaaaaagatacctttattcctattcaggctgtcaaagtataggaaaagatcaataaaatttcacattcaaatgcatattaatttattttcgttagtttagagatttcattgacatgcaagctactcaagttatctcatttttgaacaaagcccagaacacatgcaattttgtttaataaatacatatttcaagacattatttcataacctaagatggatttaggaaggttaaagtgagaaaggaagagagaaagggaaaggttagagtggctgtgactgtggaactagaaagagaattaagtgtgtggaatgaatattaagcagattcattgccacatgtcattatcctgcacccttggatgccattttcaaagtgtcatcacctatccctttgcctttgaagtaccagataacactttaacctctggtctcagtctggagctgctctttagtcttgaacttttccgccactcttctgaacaggacagtcaaaatgaaatgagcacacagagtgttatggagacagcagcaactgggggttccaaattattttggacatgcagagtagtggacagaagatattcgggcaagaatagagagactagagggtgtttaaaagccctagctaaggaataacccaaatggataattactttaattctcttttcaaaagtccaatataatcatttgcattaagtaaaaaaattgtatataaaacatttatatgtagtatatttatataaatatataaaaatatatattatatattatatataatatataatgtttatatattgtagataacatatataaacatgtatatatatataaacatgtatatatataagcatattatatatatatatgtttgcttatattgggttcacagatacagaatgtaaaacagttttttgcagaacatttcttgaggaatacactcaggaggtgcagctatgaagaagtgatgaggaatgtctcaaatcagtctgtgaactcagcatcacatttttttttccagccacttggggatgagtgcttcagttcagaaggaagatcagggccaaacatcatagcaagcagcactcagtaactatgcttaaatttctcaaagagctcaggcaattactgcattggaatatataaatattatatatatatatttactcatataatataaatattatatatatttactttccatgactattattatttttatttatttatttatttatttatttatttaatttttttgaggcggattctcgctctgtcgcccaggctggagtgcagtggcgcgatctcggctcactgcaagctccgcctcctgggttcacgccattctcctgcctcagcctccggagtagctgggagtacaggcgcccgccaccacgccccgctaatttttttgtatttttaatagagacggggtatcaccgcgttagtcaggatggtcttgctctcctgacctcgtgattcacccgcctcggcctcccaaagtgctgggattacattccatgactattattttaggaaggggaaagggaagagacaaaggacaaaaaatcatctagtcataaaacataggatatggtattggaagaagatgaaagaaaaaagaaagagtgagaatctattgatttgcatacccatacttgtatctgtcctgttttctggctctagactcaaaaactgactttgctgtcgtttggggataagtggagaaatgtttattctttgttttaaaggtagattcatggtatgtttatcaaaatcctgtaacgcacattctcaaaggcagggatcaacagaagtagcatacattactccaagtgaaggcttccatcatccgcagtacactaagcgtggcaagcctcacattcccatacatccccactagccttcctgagaaagagtatgatcagatagggcctaaggcaaggcacaagctctccagagaggatttatcagccctttgacagtcagcagggagggaacctgaaggtcatcaggaaccttctcagcccagatggtaggaattcagtagagtctcggttaatttaatgccctaatgcttaaataacaactacatttcttctcaaatggttacctattgttttcttgaacacctttattgcctaggaacccatttcttaagaaatcgattaatccatttctgtgtagttgaattcccaattttttctttctttatgctcagtataaaggaatcccctctgtgtgtgtgtgtgtgtctgtgtctgtgtgtggtgtgttcacacgtgttcttttttccttgccattctcaattttcctggctctccttgacaaatgatactttacgccctggtcatctttacccagaaaaatatattttgtatgtttctttctttagcaaatttgtattgagcccactaactggcagccattgtttaggttgctgttggtaaacagagtacgagaaaaaaaaaagaatcccagttcacatggaatttaccttcttgtggagtaagatagggaataaagaaaataaatcagaaagaaagtcaatatgtcagatggtaataaatgctttggaagaaaatgaaacaagaaaagaaaacagaaagtgcagatacaagtacagaaaagttttaaaatattaaataggagggttggggaagatttcattagagggggatgtttgagcatctctcaatcctgaaagacaggaatatatgaactaattacttgaaacaagaatatataattaaccatttgcacattagctgtcttttttacctaaatgaaattccttatgtttttataatctttattttaatgcctactttctgactttaaattattatatatttaataaaagagataggtctttgtcattgtttttctactttgaaagaactgtgtactttaatgagattattccagttatctatggctgcacagcagcctccccgaaaacttaaaggctaaaacagcaagaggtttattatacatcatagtgttgtgggttataaatgagggcagagctcaggtgggtgattctttgtgctctgaggttgatgttgacagaagcttacagctgccaaatggactgatctggtgtggagggctggagatgctttcatttcgacgtctgccttggtacagttagctgtacagctggtctcacctgggattgtaggccaaggtgcttacatatggcctctcctgtgaaatagtatcaggtagtcagactttttatatggcagctctagagcccccagagaggatatctcaagcaataagtagaggctggcagtttcctaagacctgaatgaagaaagtgatacaatgtcaattctggcgtactctgttagctgaagcagtccccagattcaagggaaagagataaaaccccacaaagaatgtgtgatcattgatattagtttcctaaggctgccacaagaagttaccacaaatttattggcttaaacaacagaagttttttcttagaattctggtggcagaagtctgaaatcaagatgttggcagtaccataattgctccagtctctaggggtgaattcttcctcgtctcttctagtttctggtggatcctggtattctctggattgtggcaacataactccaatctctgactccatttgtacatcgccttcttctctgtgtatcctattctcttataaggaaactgtcactggatttatgtaccaccctaatccagtaagatattttcccaatcggtgtattaattacatctgcagtgaccctctatccaaataaaatcgcattttgaggtttgggattgacagagattttggggaaactctattcaacccactacaccatctatatagccttctacaagatggtggaacggtccggacataacacagatgatgcaaatatcagacaattaggtccacagtactagaatataacatcgtgcaaattgtgctaattgaaaatctcctgcttatacactatcgaggaaaccgattcttatattgttttctttttttacagtgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaatacagaagtggtctttgaagttttttaaaaatatataaaactatgtgcttatttaaacagcaaaataatgaaatttacataagtcacaaaaatatgcttctgggcttttattctccattagtgaggagggatttacattgtataatccacatgtttttggtctacatctcattatgaataagccagaaaaataatcagtaaatgttatttcaaagttaataaacacaactgtaatagacagttctcttttgattgcaaataacagaaaacaaataaattggattaattttctaaaaaagaaaatgtttagaataagtgacagaattatctggggataaactccctagctaagagatcagacacagattgaaccaggaattcaaacaatgtcaacagggttaattctctcattctttgtcttcttcccttggccctattttttttccaactgggttgatttgcaagctatacctttctacaaggtaaaaaatactactctctttaatctaattctgcattgcaactcctatgaaagaattactgtctctctagttccaacagagatcatgaggcctttcttggatcacaagccctatcattttgggctggagaatgaatcactcagattggcaagtactgactcctgtgcttgcccttggagatagtgtgtggggttatatgaaagtgatgctcaggggttagaggtgtaaaagtaatttatgtccaacagaaagtcagaatactgtttatgacaaacgaagaaaggaattctggccaggtcaaataaagcaagtaaaaattaaaaaaaaaaaaaaaagtacaactgcacacctgatactttgtatacaataggtcccttgtcattgcagtccacttaaagaaaatgattatatatgaaaatcaaaaaaagctaattcaaaaatatgcaaaataaaataagtgatcaacattcccatagagaaggaagtggttaggaagagattaaaaaaacaggtctgatttgtgtttgccttgaaggagaaatagcatttggtcaagttgagtggagtagagaataccttgtaagcaggagataagttagttaagttaaggggaagagaagaggtaaataatatatttattcattcaataaatacatagtatgcatgatcatgagccagttgttttgctatcatcatttacaagttacctcattaaatcgtttgcaacagtgctgtgaatggagatgagctacttttatctgagaaaggactccaggctcagaatgtccaagtcaccttcccaaggtcaccctagtatgtagatagatatttcaaactggaatcttcctattctgtattcctcccatcatgtgatagctactataatctccacaatgctctggggacagtggcaatgacaatttgcagaagaggcttgggggagactaggtctaatagactatgtgatgttagaaatctattttggtattctatgcacaaagatatacatctaccccaggatggtggtaatagagatgtgaagaatggaaagcatacaaaaatatataaaagaaagaggattaacaaaatttaccgatttgttctgagaattcttcgaaagatagaaatcaaagcaaaacaaaaatttaggtcttgagtgtctgtggaaatgatggcaccattagtccaagtagagaataaggagaagtcagcttaacatcatgggtttgtcaaatatatagtgtaagccagactttaataagttactaagtattggggatgagaatctgaagctttaagaaaaagaattcaagggtaaaaatgtatatggaaagatgtctttgaaagtatgtaaagatctacattacaaatatttatgtgtttcctatatagacatatatttttcttggaagacctcttaggttaatgctagctacatagttaagttctcaaatattatcaacttaaaataataaaaatatgttttttaacacagaatgatccaaagtaggtgtttgccaggtggccttctttgcaataattaagaatctacactttctccatcttgtcgagccttgaaatcctctacttccagccaggaaaatgaaggagaggatcatttggggggattttatgaactctgcttgtaagtggtacataccacttcttctctggttccactggcaacaactcaaccacactggcatacttaactgcaagagaacataaagagagttgtctgacagtgtgcctaaataaaaatggaaaatttctggaatttatatcacaatctctgccacaactccttttaacataaataatatgtcagaggcagattgttctaaaaagcttatcagagaaacatcagtttcttgctaactgtgccaatttcttttcctctataggcaaccatttttcattcttttctcttattacataaatccaatacctctactaatggcacttgtcagctatgtgagtacactgctcagatttcctttcaagagagtttcttgcaagagagcagttagctgacaactgtgagctgctatattttcaaaatccccagcatatttttagcaggccatgctctaccttggttaatgcctgtcaatgactgagtatggtggaagtactagtgccaggccatttcttcacaagtggtaaatccctttaacaagcgtattttgtgttctaatcatcctgactgaagcttgctcaggcataccctacagtctgatctccctactactcaattttccttccttcactctttccttttataggtgtcagaactgtatttctatctgcaagctccttgtgttttctcttaaaccctgttccaatgatgttacccaggcatttctagcaaaaaatatttgcgggtttaattctttctgtgtctgattcttgaaaatcttaaacttagatgactctcaagttgactcacttggaaaactaaaatgttatccttcattcttctctctgccttttcttcagtgtctaactgatcccctaacaatgccaccttagaaacgctcactctcatcccttttctctactgcccagcagaatctctgttggatcctcattacttttctgagttacagatggaatttcttaaattgtgcccctgattctagtcttgatatcttcaacctacaaaagtaggttgaatatgcagccagactaatacggcaaagttaatgttgtagttcctcctcaggaggcttgcaaacgcaaatgcctcagggaactggcaggttatataaatgagtgaagcaagtgaagagtgtggtgacccataaaagtgccttttcttccacgaaaagcaaatttctcaggtgtaaggcaacaccgatccagtatgaattcctggtttttccttttctttgtttttaaggtttaaggaaactaggttttaattttttaagtttttgtaggtacatggtaagtgtatatattaattcttgatttttcaagagaatccttaatctgagtctttgtggaaaaatttctatatatttaaattataacccacttatttatgaacacacacacacacacacacacacacacacacacactctgaatttaccctgcagctgccaactttttatttctaaaatacagactactcattggtattggcacatgagacctatcttgaataaaacccggcttctctccttattttctggttaacccactacctccttacactctatacaactgtactgacccacttgtagttctctgagtattccactttcttaatgcatcatagcttttgacttttttgatcttttgtctagaatcacttagccaatctctaatcattcttcaggtcctcttatatccctaaaaactgggttaggtaacccttcctcgtgcagcagtagaaccctgtacttaatactgacacacactatcttaaccaaaattgcctattctttatgccctatctttacttctagctgaggacaccttgaactgtgttttgcaaaccattgttgttgcatcacctattgcaattttcctggtatataataaacacaaaatttttttgagttgaattaatatattaaaacaatgtttgatggcattataaatggcaatgtatctgattattttttccccgtaggaaaaagtgtaaatttccttcagctcaataaagctagttaatgttctagttatatatcttggatcattgaatatactgatctctgctagaactggttcattttcatagaattttgtggacttgtttcattggtctcaatgctcccacttttcttagtgcagttaagttgtttaagtagacccttgaaccagagcttagctataaaaatttaacaaggtaaatgccaaagcttttctgatcctttctactttctcactatgtacaaataatgtcaacatgcctactaaaagctacccttcttatgaggcttctgggatgcacattctgttgacacacaggctctagatgccatttgggaaaataagtggtggagttagatatgccataaaatgaagagtttggaggtttgcagaagtcctcaccctgaaattctctgggaaaactcagttacatgttgatgaagaatagtaataattgaatcgcattttccaacaaagtgggctatcagctttcctctttgaagaaaggtaattttccacttaacttagaaataaagtggtgctagcaatagtaataatagaagaaaagaagttgcttttcttctattatgtgcatgttacatatatgtacacacacatataaactaacttttctgaataattataattgatgtacattgaacttttactctgtacaaagcccttaacatatattatttgatctaatttttccaagaacttaatgaaataagtatgttgttatccactttataggttgcaacttagaatagctaataatcacacaaggtcatacagctagcaagcagaagaactgaagtcaaaatcgctccagatctcttgttctgaactattatgttgtattagctgtcagtataatattacaacttgaggataaaatctgaaggacaataataaaaactattccagaattaagatcttgggtagtctctattttccacttttcaatgtgcaattgtaattcagtaattctgctagtagaaacatagttctgcagaatcctttgattgttactaccatggtagaggaaggaacaggcagttatccttgatttcatttctgagaactccatttcaacagcatgagatttgcttgacatacagtgaacccttcaagcaaacatgttcccttgaacattcaacaaataatctaatttggaaacaccaaataccacaaggaaaaagtagtacttttgttctattttctgacagatttccacaccagtgatttatggacgtatgttaagtttaggattcttatctgaagccaagaaaaaaacctttatatttttgaagcctatcatcctcaatgatggaagccaaacccttggaatgttgctaaaatcaaggatgagagaatacagaatgtcatgtactatcaagaacttattgactttcatatggttctcatttattctcatacatggcaaattgaaagccttgggaggaagccaatacaaattgttacagataacactatctaaatttaactgccataggtatgcttcatataataaatatatatttcatatcagcaactcagcaaggcaaaaattgaaacagactctagtcaaaattcatttggacacaatccttcagagaagactcaatttgccaatataattatttatcttggtctggagagcccttaatactcaattttatgtttctgactctagagattttatacacacacacatatatatacacatacatatatacacataaaatactctatggaagttagaacattgaaatcataacaatatcttagggtaataaaattaagtttgaatacatgaaagtttagtacctgcctgcagaatcaaatagattaatttgttgatattttcaaatttttaaagacatttttgcaacagaattttttcttggtttaatgggttcagtttgaggcatcatttgagcattaaaggctgtggcatgacattaatttttagcctagtgtgatggttcatttatcaagtgcttaacagagtatctagtatacaataggctagtaggcatacaattagtctttgccaaatgaatattaaatgtattgttggaggacaaatgaacaatattatctatttcaacaattgtagcagagattctgtgcaacatgcagttgctttccatttagattaatgtttctctgaaacagaaagttttgtagaggaaagtcttatctaacacatagacagattcagggcccagcacatagaataaacccataattgttgaataatacacatttataatgtaaaatcactatgggtaacaaaggaatcctattatacactttcctactctggataaagagaaatatatatatttacatacatatatacacatacttaattattaaatggattaattatatacatatataaatatgaatataatatatataaatatgaacacaatatataaatacaaatatgaatacatatatacatatatttatatatacttatgaatacatatatacatgtttatatatacttataaatacatatatacatatatttatatatgtatataaacaaatttatttatatatatacacatatatttatttattatctggcttactaatacttaaagaattaataaatgccaaagccagggatatgactaaaaaactaagatatctttccttttaagatagctatgattgcataacatgagacactgtggttgcataatatcattcagtgacttaaaacaacaaaagtcacttatttcatgttttttgcaggtcaggaatttatacatgggaaagcttgtctctgctccatgttgcctaaacttcagatggaagactcaaactctggcattggattcttctgaatatttatttgttcctctatctggttattggtgttggctattatcggggattcagctaagctcacacgtgccttcacaatgtggcggttggttccaagtacagacatctgaagggaggggaggagaaagaggaaggatgtgagattttaccctacttacaagccaacaatttggcctgccacattttcatggatattggcagttgtcatgaggtttctgggtcagagacaaagaatagtttggtactcacagcagtggcagtatccagtgtcaccattttcatacacgaattccccaaggcctaatttctacaaagttctgcaaagagagccaagtcttgcctgcatatgcaatgagttttgttgaagaaaaggaaactcatgtttaaggaactacaatcttttataattggctgcaagcaaaactgcctaacaatttcttcagagagaaatgtctttatcatatcggagagttaacaaatctaccatttgctgcaaaggggagtactatgtctttattccaaggttatttaccatacaaatatctttgaaaagataatgcggaaaagagggcagttagtgcctctgcttgaaagatatgcagaaacatgaaagacccatagagaatcttttcctccgaaagactcctttcaatctttgtggttaagaacaatgaataaatttaatgtaaactcattaaaagatttaacctcaaaaaattttaatatccacatttaagatttctttaggagagaagaaatcaactcccttaccctcatcctcctttggttaggaatgactacacagcatagaaaacttgggactgttaggcattaaacaatcaaaagattcttctcaaattaagataatagcttacatgaatattttatgaaaaatagccacatttgataggcttttcattaaacctatatataatttgggtagaattcacacctttacaatgttgagtttttcaatccacacatacggtatgcctctttgtttatctacatcttctctgatgtctttcattagcattttgtaatttttagcataaagatcttatacaagtatttttttaatttgtacttaagtacttcaattcccttggcataattataactgatatatatatatgtgtatatagatatacatatatattatttatttatttatttatttatttatttatttatttatttttgagaactctgtcacccagactggagtgcagtgacacaatctcggctcaccgctacctctgcctaccaggctcaagctattctgctgcctcggtctcctgagtagctgggactacaggagtgcaccacttctgtccagctaatttttggatttttagtagagacagagtttcaccatgttggccaggctggtctggaactcctggccttaaataatctaccagcctcagcctgacaaagtgctgggattacaggagtgagccacttctcctggccctaatattatatttttaatttcggtttctacctgttaattattgaaacatggaaatgtgattaattctcttgggtttggttatatattctactatctagttgcattcatacattagttctaagtttttattttgtagatgctttgggatttttctatgtagacaaccatgccatccccaaactgtgaaatttttacttttttcccttccacttgtatgcatttttatttctttttctttctttattactctggctagaatttctcctactatgctaaataaagttgtgagcagacatctttccattgttcccagtcttaggaagaaagctatcagtctttcactactaagtttgatgttacctgaaattttttgtagatattccttatcaagttgaagatattcccctctatttcaatttttctgagagttttttttcatgaaaaagtgttgaaatttttcagattttttttctgcctcaattagaatgatgattttttttttctttttgatttggtgatcatactgattgatttttgaatatggaatttgtcttgcatacctggggcaaaatatgcattgttcatggtgtgtaatcatttaatacattactgaattcaatttcctatgattttgtagagcaatttgtgttgaactttctgacacatagataggtgtagtttttgcccatcttttacttctttaatttttctttattttctttgttgggctttcgtatcaggataatactggcctcataaaataagttggagaacattctttttttattttctgaaagagattgtataaaattgtgctaattcttttgtaagtgttagagaattctctagtgaaattacctaggcctggagatttctctctcaagctattttaaattataaactctatttaataactacacaactatttagtttatttcaagttggttcattttggtaatttgtagcttttgaggaatttctcaattttaaaagaattgtcaaatgtgtgagtataaaaatagtttgtattattcccttgttgttctaatcattatgaaataataccacttgtttcattaccaatgtttatgataattgtcatgactattttttggatttttaacacttttattaactttttgggataaaatttttgttttgttggttttctctattgtttttctgtttgattcttgtttgtgtgtgctgtttataatttctttcatttgcttgctttgggttattattttctctttttttctagtctcttaaggagcttagattgtttatttgaagcattttctcttttcaaaaataatcatatagtattataatttttcttttattgctattttagctgcatctcattaatattgatgtttgttttaattttctttcaattctctgtatattttatttgacttccttttttatccatggattatttaaaagtgtgttttttaattttcaaatgtttagagattttcctcttgtctatcattgatttcaaatttgattctattaaaattaaatagtatattctgcatgatttcgattattttaaatctactgaggttagtttagtgagccagcatatggtctatcctggtgaatgtttggtggacaattaaatagactgcatattgtgctgttattgagtggaatgttttatcaatgtaagttgaatcttattggttgacagtgtttttccattctcctctatctttgctctctttttatctaatgcttctatttcctgctaacagtgggaatttgaagttctcaactacaggtatagattggcccatttcttctttcagctccatccaattttgctttgtgtattgaaaagctctgtttttttttttttttttttttttttttgcacatacacatttaggacacgatgtctcttgttagattaatcctgtcattactatgtaatacctttctttgtccctactaattttctttgctcttaagtccactttatgtgttatgcaattatatatatattacatatatttatatgtaatatatatcattatatattgtattgcctcagagctaaagcaattttacctcctaaggtaaaatagagtatgcaaacaaatattggccaaataccttacttttaaaaattaatgtttgcataacatattttcatccatcattttattcttaacacatctgtgtcattatttttgaagtgagcttttgtagattcaatgtagtggggtcatcgtttttatccattctgtcaacctctgtcttttaattgatgtatttattccatttatttgtcaagtaattatattatggcttaagtctgctaatttactgtttgttttctgtttcaaattatgccctttctcttttcttgcttttctgtgggttccttgacctagttttattttagaattacatttttgtttataaaatttttgaataattttgtataattttcttaatatgtgctcaaggtatgacaataaacacttgcaacttcaaaaagacatgcaaactcttaaaatgtttatgtgaacaaatattatcttctttacctgtggcaaatgataactgggctagagatttttataagttcttccagttctaacaatctgtattatgtgatatttactgttataaatctattaaaatttgaaaatgacagtgctgtatataacaaaataaaagcctatgactctatccatgctacttagcagggctttttgaactggtttgtccagagtttaaagagttatttcgaaactattcaggaccctcttgcttgcttgtggtaattcagaattattcagtacataagaggagttttaagcacttgtgttcttcgtgctcttaaaaataaatgcaccctaatttgcttcttgtattttttataattttacatagtaataaagacttcaatagttttaagatttgtaaaagtcactattgtaatataagctgacacctgtgattggtttatttggttgtagatcactgaacaactgagaaaagaaaaacaaaagcacagagttagcaaagtttctattatcaccaatataggccaaaaattccacgcatttattcagtggcaacaagtaatgtaggttttttgttgtttgtttgctttttctgagatatctactctgtgccaggcatgatttgaggcctcagctatgttggtgaaataggcaggtaaagactgtagggaagatggaattaaagttactgttgaagcccgaaaaaattctagttctttttgatccttccaagagctcagatgctaagatgatttgttgttcccacaatccatgcatcattaaataaacccataatcactaagtaaactatatattttctgttctttacattctgaaagcttctaagggacacccttagccatgatactgtatggtcttgaaaatttggctaaaatcatttctatttgtatacctctggatgttttaaacactacagggcttttaaaaagtgacattttgaatagataagaaaataaacattggtatcagcaaatattagatattactgtgagttcttgctgttatgcttgttaaaaagtatcatgatggaaagaaatcaggatttagaatcaaacaaatctgtgttcaagacccttagctgtttttgttagttgaattcaatgctggctgaactctaaagactcagttttttcaccatgtaaacaataatcattatataaagctaatagagctggaaagataaagtattatgggtaaactgctttccttagtttatctacttaagtagtgctatttcctttctttatttacttaccttgatccaagtgaaagcctagttttaggatttacttttaccaaaattgtactctgaaccaaatgagctcaaaagttcaactttgaaaagtcaaaatcatagaaaatttttacattgaaactgctcaataattgttttcaaaatgcacagcaggacttctcttatttaccatggtgaataaaatgactttagtttttgacatttgaagtatataataataaaagttatagaagttagaaagcttccttcagggaaatggaatatttttacttcctatgaaagtgatattttggtctcaatttaagtaacacaaaacttagttttcatttcctggttttaaatgataagctgtatattcctagtttacagtaaaccacatatttttagagagttagaaacgttgcttcaaagtggtagatattaagtgtcataaatgtccaggctgtaagtatggtttcctgttgtgtaagacataagttattaggtttagtttgaaatgacacaaaatgttcccgacttctaacaattaaaagaagaaatgtgaggctccgagacaatctcggcaaatttgtattctgattaaaataattatttgatcctatacagttcagtgcatggaaaaatgttgtctagttactcaattcaatgtggttgttagagaagaaaatatgtctcttatgtggggtttgagcttcatgtagctttgtgattgtatttgtttactcacggtggaaatctccttattaaattgtgggcaagaggcaacccatggtggaaatctccgtattaaattgtgggcaagaggcacttctattggtttttctaacagtaactacttacttcaggaaggattaggttaaaatactaaatgtagatctctagagttgatcttgtaacagaactagaacacattgacttgatatttagacatgtgcagaaggcaaaccatttcataaagggctggatataatttcttctttcagttctaagtcaaaatttaataatttttttctatttttaataaatatatgggcatatgcatctaatagtgaggtttggtaaagactcttcttcactttagttttgcatgtgtgggcaactgacctttatgttgttacaaaatactacttaaaaataaaaagctcaattctgtacagaaatgagccattgttcgttgttaggctctcattagctgttatagtatcaacactattgtcaacatgatgtggatcttgaattgttttcccgtctccactgctaactgtgtgttcctcttgttcttcgggccagttgaaccatacatcttgtgtcctaaaaccatatggagcatgtttttgtatgaactctcatgattaaggacatctgtctcagcctctacgtttgccttcaggggatctttgcatcatttaatggtacagttaacagcatgttttgcatcatgaagttggccgtacagtttttctgcggattctactgttttcattccttaaaaaaacacatggacgagtctatattttgtctttctgtctcccattctaactttcttgcttttcttcctccctcattctctttcttttttttttctattaatatttactggccatcaccttgtgtttagcaggtcttataatattccaaaattgcacattttcaaaactgtaaagattgaccacaatttctaaatgtaattcacttttcctttcaattgcttgttttgagtgtaatttggataccctaaagttcatgtgttacttttctatttattttgagtaatatgattcagattcaactcctttagatattactgaaaatattcttaagtgaattgatacaaaatatccacattcctcataagttatcaaaccaaaatgttgctaactctatactgaaattctactaattcttctgactgtacagattgattcgtcagtatatattagcaagtatttaattaaaatctattttaataactttaaatggatatagtagcactctaaataggaaatgcagtcattgaaactctcaaacactagggaatagatataaaatatgtgcatttaatcaattatatgttgttgatttttactttataatctatgacttcctttgttgatgtcaatattgactttctttaaaaatctctaaattatgaaaaagtctaagttattgtaatctacattatagactttttctagtatgttttactcataggtaaattgttactagtcccattaattgcaaaatgcagtggtcatgtgtttccaaataatttcaaattgtagaaataaatacagacagtctccatgaaagcatattgattcaagaattctatttattgatatttatttactcttcctaacatttatatttactcttcatagtgcataatgtttgttcagcagaaatatcatcaaaaaactattgatgtgccagttaccatgatgcaccgaagatacagaaacgaacaagatgtccccactctggtgaaggagtctatttgttgttggtattgacagtgtgagaggcagatgtagaaacaagattgacagactttgtatttaaaggtgtaagtttcataaatggatacatagaaaaatgaacacgtttaaattaatgatgtaaacatgttaatattcccaaatacaaatataagtctgtacagtgacttgcttttttaaaaagcattgaagtggaatttgcataccatgaaattcacccattttaagtgtataatatgttgatttttgacaaattttaaaatcttgctagcatcaacacagtctagttttaaaacccgttcctcactccagaatgttcccttgtgcccttttgcagtccctcactccacattccagccccaaacaatcactgatctgctttttatctctgtagattttccttttctagatatttcatgaaaatgcaataataaataatgtataaatcattaaagatttatagcaaatgtagttttgttacccttttttcatgtttctcaaattgtttgtacaaggaaaattatttcagttggtattttgaaatgtgggagaggcctttgactaagaactttaggagtaacacccctaactctcattatcttcattttacagatatgaagactgtgctttataaaagatcagacatttggctaatgacactgctactaagtgacaacagagatttaaaactagttctgtctaattctaaatccactgatacagtttctcagaaagttgaaaaacttttaacattataaactcattgatagtgatggatatttgttcttttgttgtttagtgattacctcaagatctacaacaatgatcagcaatacaatgggagttttagttgtaatcagctgtttcatattttaataattattaaacactcatgtaccaaatacaatgctagctgcctgaaattacaaaaggaataaggtttgatataaagtaccacataggccaggcgcagtggctcacatgtgtaacaccaacactttgggaggccgaggtgtgtggaccacctgaggtcaggagttcgagacctgcctggctaacatggcgaaaccttgtctctactaaaaatgcacttagctgggtgtggtggcagacacctataattccagctacttgggaggctgaagcaggagaattgctcgaaccctggaggcggaggttacagtgagccgagattgtgccattgcactccagcctgggagaaagagcaagactctgtctcagaacaaaaggtaccatgtagttttcacttgttctaaaaatctcctctcattgtgtaactcaagtataaaaatccatattacatctgaaaaaggagttattcttctgaactctctctaccctccttaaagccaagtatatgccactttgctatgtcagttgatttgacttatatttggtacacagattgcatttttttttttgtaggacagaagaactccctgtcaagctagtttaactgtattacatctaccaatattcaattatttaattttttcaaaagtgaatgcaatcataatacatccaaatacaacctgaaactgttgggaagtaatgcttaggacaaaatttcaatctggtttactggaaaattttagcaataagtaaaaatcttaatgtgtttccatatgcatggtttcacacactttttatcaagtactagaaaaacactgaatgctaatgccattgaattttgctgaattagtgtactatataactcctttcatattaaagattttacccacttaacctcaccagaagtagtgttttcacagtgcatgattatgacaaagatagaatgatagggagaggggaaagtgccatcaggttcagggtcaacagaaaataaaactcgttctctttttgtaatcagttataattcccatttcaatcaaaaaaattattgtaaagtattttcttgaaatttgcttaaatttttcatttttaacaagaaacgttatttataaaacacattacttgtgtgcatataggtgttgggtctgagaaagtatacattattaatttgatgtgttattaaaagattgctgtcaaaaatctgtttagttaattgatgctgtcaattgctcgcattaatacctaatactcataatatttgtacctaaatttttcttataaaattgtttctcattggtttttattctttttatttctcctattttttaaaattgaagtttgtagtcaggtcatgtgaccacatcaagtccatcattcaaacacgtatcaggaaattggaaatttaaaaatgacttatgcatggatatgatgccagaggcagagacaagggggtgggggctgtttctaaataccttccaataacaataaaaaaacggaagttatttgtgatcttagaagatggctaaggaaaaactgaaacctgaaactgaggaaacaaaagtttagacaagataatcccaacatcagagaaagcatttgtcattgtcagaactccaaagagcaagaaagctttaatccatttcatggaccctaggactcatggtctagtaattcttatgtcaccaaaccatcttaggatctgtatgaaattacagtgtgtcaccactctacatctgcaatcttaatgtttccgtcctttgattgtatgacaaggaaactcttgaaccagagcactgcacttcacaggagtctgaaagaaccagctgctcataattttggagttttatagggctttttagtctcagaatccctgtctgacctatgtccatatccagaattcattttttttcatttccagaattcttcagaaaaaactcttgctgtcttttaacgtcttaaaacatttttcaaaaaatatatagagagaattagaaagccactcatagacttaccctctttctccgttgcttcttcagttgtgtaatagtcatgaaatctggaatgaccattttaaattatattcactgagtttgaaacaaaacgtttttagatggttttgttcccttaaaaatgaatattattgtctagcattaacattcacccaaattgatagcatattgaattatgtgtgtagattcttaaacgttttgttgtgaaacatcaaaagaaatcactgactttttatttaacataaataaattaagggaagtttagaaatctaattgttggaaaaataaacttctaaacataactcttcaaaagtctacgtgctcacattttctattcccgaacaaaaacttttgcaaagctctctgaaagccttgtaaaaggccaatgaatttcatttagcattaatttccctactcaccacatagcaaatatatgacacaacttatagttctgttaaaaaaaagccagaactgttacctgagcaactgcttataaaagagcgaggcagcttacgttttatctattttttgtgtgctttctactaagttttacaatctaagtgtgttagaaataaaatcaaattcattaggaatctctatgcataaaaggaaattaaatatcatactcaatgacttgtgccacctgtggcaaatagttttacatgccaatttgtgttttcagggtttttttgtttggtttctttggtttgtttatttgtgtggctttttcttttttttttcttaagaaagtgtctctttgtcattcaggctgtagtgcagtggcacaaacatagctcactataacctcagacatttggccttaagcaatcctcctgcgttggcctccaaagtgctaaaattataggcatgagcccccaagcctggacttttccttttttaattgctgaccaataatagttaccatacaaatttcagttatggtccatggttgattcatttttaagatcacaataaatgtatattcttaaaaattatttctacaaattatgaatatttaaatgaaaatacaaagggttcctttcattaagtttgggagatgttatatgctctatatcacctgttgatgaatctctatgtttgttcttaacttttccagaaagttcagtactaaagcatctgtttaatggtgttcattctacatcattcaaatttatttaaccagagaatgcttttcactaggtatctgttttgcagaacacacactgggaaatgttgtcgggtactgtactgaatcacactacaacattttgtactgacatgatggtcaaaggttgaaatgtttttcttatttgttttcttatacatttagaaagttaatgcaaaatatataaggtaccttgtccatcaagagacttgtcatctatcatagcgtgtatgtgttgctctctcttttcctaagatgctgcatatccctcttctgttgattcagtagaaaattttatgattatttttcccttatatccaaatgcaaaggagtttaatcttaaagacatcttcttaaaagcttcttaaaagaagcttaatcgttccctttgaaaaccggcacaagactaggatgccctctctcaccactcctattcaacatagtattggaagttctggccagggccatcaggcaagataaagaaacaaagggtattcaaataggaagaaagaaaatcaaattgtctctgtttgcagatgacgtgattctatatttaaaaaccctatcatctcagccccaaaactccttaagctgataagcaacttcagcaaagtctcaggatacaaaatcaatgtgcaagaatcacaagcattcctatacatcaacaatagacaagcagagagccaaatcataaatgagttcccattcacaattgctataaagagaataaaatacctaggaatacagctgacaagagatgtgaagaacctcttcaaggagaactacaaaccactgctcaaggaaataagagaggacacaaacaaatggaaaaacattccatccttatggataggaagaatcaatatcgtgaaaatggccatattgcccaaagtagttcatagattcaatgctattcccatcaaactaccattgacattcttcacagaattagaaaaaaactactttaaatttcatgtggaaccaaaaagagcctgtagagccaagacaatcctaagcaaaaagaacaaaactggaggtatcatgttacctgacttcaaactatattaaaaggctacagtaaccaaaacagcatgatactggtaccaaaacagacatacaggccaatgtaacagaacagagacctcagaaataacactgcacatctgcaaccatttgatctttaacaaacctgacaaaaacaagcaatggggaaaggattccctattttataaatagtgctgggaaaactggctagccacatgcagaaaacagaaactggaccccttctttacaccttctacaaaaattaactcaagatgaactaaagacttaaatgtaaaacccaaagccataaaaaccctagaagaaaacctaggcaataccattcaagacataggcatgggcaaagacttcatgactaaaacaccaaaaacaatggcaacaaaagcaaaaattgacaaatgggatctaattaaactaaagagcttctgcacagcaaaagaaactatcatcagagtgaacaggcaacctacagaatgggagaaaatttttgcaatctacccatctgacaaagttctaatatccagaatctataaggaacttaaacaaatatacaagtaaaaaacaaacaaccccatcaaatagtgggcaaaggatatgaacagacacttctcaaaagaagacatttgtgccaccaacaaacatatgaaaaaaagctcaacatcactgatcattagataaatgcaaatcagaactacagtgagataccatctcacaccagtcagaatggcgattattaaaaagtcaaaaagcggacaggcacaggggctcacacctgtaatcccagcactttgggaggctgaggtgggcagatcatgaagacaggagtccgagaccaggggttcgagaccagcctgaccaacatggtgaagtggtgaaaccccatctctactaaaaatacaaaatttagccgggtgtggtggtgcgcacttgtaatcccagctactcaggaggctgaggcaggaggggaattgcttgaacccgggaggcagagggtgcagtgagccaagatcgtgccactgcactccagcctgggcaacagagagagacttcctcaaaaaaaaaaaaaaaaaaaaaaaaaaaaaaaacttccagaagtaatagaagctggagaggctgtgaagaaataggaatgcttttacactgttggtgggaatgtaaattagttcaaccatcattgaagacactgtggtgattcctcaaggatctagaaccagaaataccatttgacccagcaagcccattactgggtatatacccaaaggattataaatctttctactataaagacacatgtacgtttattgaagcactatttacaatagcaaagacattaaaccaacccaaatagcaattaatgataaactagataaagaaaatgtagtacatatacaccacgaagtactgtacagccatgaaaacgaatgagataaagtcctttgcagggacatggatgaagctggaagccaccaccctcagtaaactaacacgggacagaaaaccaagcaccatatcttctcactcctaattcggagttgagtagtgagaacacatggacatggggagagaaaaaacagacaccggggcctcttggagggtggtaggggagaggagggaacctagatgatgggttaatagtggagcaaaccaccatgacacacatatacctatacaacaaacacatgtatcctggaacttaaagtaaaataaaattaaaaattaaaaaaagaagcttaatcaatgaggatagaattaaaagttcattttcccaatgattcagctggtatggaactcagtttttatttcattatacttaaatcaatttagtattatatgtgtcccttttatgtttcttatataatgcaaagtaaacttcactgagaagaatatgaattattgcaaacttggttgctattttgaaactttataggttcataccaacacaatgtgaggacactttgcaaacacattaaaacaaatattaggttttcatacgaggaaaatgtgcaattaccaaaggtaaacttgaaaatactatctttcaataaatgggtcctcacttttatttggaatgagtcattttatcctgaaatagtgcccaaaggctaggagcagactgaccccaagcaggactgcttgcaaaaacattggtttggaaatcactgggcagtactgccctagcactgtgcctgggataaagtttctttcatcatttaaagtttcccattcactcttatcaagtatgaaatgtaataccccttgtagttcaaagaaattttgttttgcttccctttctctcagcgttgctccagtattgacccaaagcctccttgataagtcagttagcctgatatcactaaacacgtggacagtaaatgttctgacagccgaggaagcctcggggaaaggaaaagaagtaggaagcaaacagccccctgctgtttgggccagaatttacctcaatttcacttccagaatggcagagagagaggattagtaatgttccttctggagccatcagcaggtaatagtgctttcctgctcatcaattaggcccacggctgtcactgccacctgggtctccttgggggacttggctgcatcccagtgtgtgagacacagagggaacagagtcagaaagttactgaccactgcttaagcagagccactcagtgctgggtcattggttggcaacatataccagtacgtttagaatcatgatttttgacagaaaatggaactccaaaatataagacataaaattgaaagtgatgccatacagcagaatagatttgagggagaaagcatctccatatgtacatttctttttccctaaagaccctgtttattctgaccttagcctgacctcttcttaaaatcctgttgccgcaaactggagcaatgaggtcacctcaattctaccttgactgcttcctgctaatagtttagaatcctaaatagttctgcatgcttctctaggttgtttcagccaaaccagccagtcaccctgaggtatgcaatacagatgccatattaagactcattatgtctaaaaaagtgacatgtcgtacttacaaagtcaaactgaaatatgtctacctgtgtggcaatgtttggcaaaattactattgaaatcttcagagagattttggtgattatacagtctctcatcggaaacatagtgatagaagtaaaactgtttgaatgaaggtaagatggggcgatgctaatttgtatctacgtcgtcagagctgtttacgtcaatgttttcaaacaaggcgttttattgagaataacacatagcataaagtcaagatcagagtttgtttttcaatgaagctaattctatctcatttttaatgtatatctttagccaatggggtacaactggccagtgacctcttggagaaatagtgagcacagttcttcatttgtctaatataagagattgtgtattacataggactaaggaaaatttatcattgtgacaggaaaagataaatcatctaataactgaatgataccatatgtagaaactttcaaaaatatttagtactttctaccctttagagtggctcacttttgtctgcatccactctccttggtatcttgtagttgaaatcaacaatataaattcagtgacttctgctagcctggaaacaaagccctgattgatggttctagcagggaataggtaggcacagataggagctgagcctttattttcaagtagcatcaagccggacacaaatcaatcaaatcagaacttgccgctacccagacatgaagctgttcatggataataggatgcttccacttatcatttttatcttacatcaggagatgttaagtaattccagtcatccttgaataaaactgcaggatgaaatattcatcactgtgtttcaaaacaaaattaacctttcaaaaatctttaaactctttcaaatataaattttccataacacacatagtaagggaaagaggattttccaggcataaaagtgggaaacaatgatacaagttacacatccttacacatcatataggataaaactcactcattcttatcaaaaataaatatttcttaggtctgcaacaacttcaggtccaagaagcacttgacaaaactattcagactttgtctttggggagctttaggtgtcagacttgagctctgaaactcaagtcacatccggaatatctagggaattacatcagtcatgagaagcaagttcatagtagcagagttttgttttgccagaatataagagtgaataccaacagcaatacctaatattgccatgtgtgtactaggttgtaattacattgaagtggaatgcttcaagtttagaaatcagccttcataacctcacaaggtggtttttttttttttttttttttttttttttcacttacaaggggcactgatattttttagagctggtagtcacacatcaacaaaattcattttctcttatgagaaactaagattatatcagagtgtgtttatatgtgtgtgcttcttccttctaccctgcagctcttgctagtataaagctgcctctgatgtggaaatgtggatgcctaccaaaaatagtgccacatgctgccatttatggatgtatcccaggggatgtgaaagagggttctcaagccctactagtcttattttagtaaattctttcatctgttgtatttttcagttcaaatcggaagagtttgttgcttgtctaatactagatgatgcattacattgaaaatgagaaatccacatagcaacaagaatacagtgaaagcgcaggcttctacttaaaagctgagtaataccacatgtaggatgctaaatgtttataaaactttgtgggtgggttcatggaatcaaggcctttccttcgatttggagacctgtttacagctgtactcagtagaaaggaaaatatcactgggcttgccacttccaaaataccactagggaaagaatgactaacttggctggacatttagttttcaacttaaaaatagtattaatatagagtttatttttttctatttcttgattggaaagttggtttaattattgtgttgccatttggcacttaactttagctttgcatcctttggaaataagcacacattttattatattttaacatactaagggatttatgttgggtttaaaaatatgatggaagaattttatcatgtcaaagcacaaaacaaccataccaataatgcattataggtgatgatcaatgcatttaggttcagtcctccttagaccataagcatacaccttcctgtttgggaaaggtggaagttgtccatctggttcagcctctactaaccttgtaaaggaagaggctcacaaaaattccttcaagaagctgcgtgccagggttccctaagaccacccataggctggttcagcatgaatttgccaactcattttgtttttatatgtgaaatattgtaaataaatggtagaaatgtccataaattcaaagtatacaatgtttacttaatctgcatacttgtcttatcacagacttacgagaatgtttttaaggacctccacggaggaagattccacagttttaataagcgatttattttacaattcaactaacatgaagtatatactatctgacatataatctttaatatgtaaattagttccatctccttttgataaaatctgagtgaaaataggaaattacttattcataatcttataaatattgatagatttaaaaatcattcttagggttccatttagctttcagccagaacgtatatatgtatgtttattttatatatatatttcaggtggggattttgccagttgctgaatatgcctattcaattgcatcttccagaactggggaaattagaggaccaactgggccaactgtgagataaatttgagccaaaacaccattgatcacttgatccccatcaccccctactgtgactggtagactacagtgacactttggctctccaagtattagtgtcactaatgctctaaatgtttcttttcctttctccaatgcatagtcatcttggtaaatggtgacaggtccatttgaacaaggttggaagaagaattaacagtaaacttttgacagtgtagcaaggctcttcctcaacaggatccaggccccttcattcaaggggttctgagtgtacactgctatttactatagtaaccttccagttaccttagaataatatatatttattcaatttattaactgttgtgcagtattgaatagtcattcacctaggaacaaatgttttaatttgttccaagtttctaatgctcttgcaatgcaacaaattagtgcacactctctcttgaacatgtgtcctcctcttggttagattcaaagaagtcatatgttggaaccaaggagatatatatatgtgtgtatatatatatatatatatatatgtgtatatatatatatgtatgtgtatatatatatatgtgtatatatatatgtgtatatatatatatcctttttgaaaatttcttattttcactcagattttatcaaaagagatggaactaattcacatattaaagattatacgtcagatagtatatacttcatgttggttgaattgtaaaataaatatatatatatggatatgtatgatttcctatgttagaacacacacactatgttgcatccaaatttaatcaccaacagtgctgtgaaaaagcaaatttccttaccattgacatcatggaaagacaaacggtaatgggaaacatagaggagtggcattctcggcagtgcgatatctccgttcatgaaaagagctagtccttctaagaccacagacacatggcttcctgtttgtgaggaaagggagttgtacatttgtttaatcacacctccatccttggaagagaactcaagaaaactgctttgctcattttctaatttggtagtttgtcttttaattgctgaattgtaagagttcttcatatatcctgtataatagtctcttttcagatatttgatttgcaaacatattcttcaattttatgaatagtcttttcattgacttgatagtatcctttgaagcacaaagctttccatttttagtttgtgttttggtgtcacatataagaaacgactctgtaatccaatatcatgaaggcttatgtctatattttcttctaagggttttctagttttaacttttatatttagaatttgataacttttgagttgatttttttatatggtgtgagttggaaatgcatagattttggaaatgcaaattgaattttgaagcatctttttttgaaaagattatttattccccttatgaattttctttgtatccttgtcaatactcaattggccataaatacaagagtttatttttggcctctcaattccattccattaatctatatgtctatccatataacaattccctgtagttttgattactgtggctatttattatgttttgaaatagagaaaatgtgagtcttgcaactttgttgttctttttcaagactgatatgactattctcattcccttacatttctatatgaattttatttttatttatttaacatttaatttatgggtaaatagtagttgtatatttatgagatgcatgagatattttaatacaggcatacaatgtataacaataacatcaacgtgaatggaatattcatcacctcaagcatatagtatcaaatatggtaaatatgccacattttctttatccatttgtcagttgatgtacacttaggttggttccaaatcttggctattgtgtacagtgctgcaataaacataagcatgcagatatctcttaaatataatgattttcttattgggagtatttaccagcagtgagattgctggatcatatggtagttctatttttaattttttaaggaaccttcaactgttctccagagtggctgtaatgatgtatattccaaccaacagtgtaggagggagggttcccattttttcattttcttgtcagtgtttattattgtctgtcttttggctaaaagccatttttaactggggtgagatgatatctcattgtagttctgatttgcatttttctgatgaccaataatgagcaccttttcataaacctgttgccatttgtaggtattcttttgagaaatatctattcaagtcttttgcccatttttaatttgattttttttcctattgagttgtttgagctccttatatattctagctattcattccttgtcagaaaatagtttgtaaatatttcctcccattctgtgggttgtatcttcactttgttgattgtttcctttgctgtgcagaaactttttaacttgatgtgatcccatttgcccacttttgctttggttgcctctgttttttggggtattactcagaagatctctgcccaagaataatgtcctggaaagatcacccaatgctttcttttagtagttttatagtttgaggtctcagaattcatcttagatttaaatctttaatccattttgatttgatttttgtatatggtgagagacaagggtatagtttcattctgcatatgaatatccagttttctcagcactatttattgaagagactgtccttttcccaatataggctcttggcacctttattgaaaatcggttcattgtagatgtatgaatttatttctgtgttctctattatgttccattgatctatgtatctgttttttgtgtgtttgtttgtttgtttgttttggagacagagtctcactctgtcaccaggctggagtgcagtggcacgatcttggttcacttcaacctccgcctccctggttcaagtgattctcctgtctcagcttcccgagtagctgggactacaggcgcgctccaccatgcccagctaatttttgtatttttagtagagacggggtttcaccatgttggccaggatgatctcgatgtcttcaccttgtgatcctcctgcctcggcctcccaaagtgctgggattacaggagtgagcaaccgtgcccagccaaatctatgtatctgttttaatgtaaacatcatgctgttttggttactatagcaatatagtatattttgtagtcagataatatgattcctctggttttattctttctgctcaggatatctttggctagtctagatttttgtggttctatataaattttaggattttttttctatttctgtgaaaaatgtaattgatattttgatataattcaatttctttttgtattatatatttataaaaactttctatttctcattgggttattttcagtagttgtgtcttcctagaattgtgttcatttcattgataatacctaatgtattagcataaaattataaataatggctccccagcaattatttttatttctgtaaggttgatagtaatgtgtctttttcattccagattttagtaatttgactgttctattacttttttttccctcttggtcagtcatgctaaatgtttgttagttttgttaatattttaaaagaatcaatttttagttttattgattttctctattgtattctagttcatattgtttctcctcattcacttttttcctattctaatttattgtccttatgcttacattgcatttagtttgcatttctttttcagtatcttcaagtgaaatgataaattattgatttgagatctttattcatttttaatgtaaggatttactactgtgaattttcatttcaacactaaagtagctgcatcctataaatttgatatattttgttttcatttttatttatctgaaagtgtctttttactttcccttgtaatttattctctgatctatttattatttaaatatattgtttagtttccacatatttgttaacgtcccaaattttattaaattattgatttctgatttcatgtagttgtggtaagaaaacacactatatctaattttaatcctttaaaatttaccgaggcttgctgtgtggcctcatttatggtctgtattaaagaatgttccatgtgcattagagggtaatgtatattctagtgctgttgtgtagagtgttctatatgtgcctaataggtttagttcataggattattcaagccttttattttcttaattttctgtctagttattccttgatttattgaagtgggttattgatgctgatagctgtaaatatttaattgtttatttctctctcaattctctcagtatatgtttcacattattttgtggcattttttagaacaaatatgtttataattgtcatatttccctgggttaagcctcttatcactataaaatattcttttttgtctctagtaactattgttgcattttgttgtattaaaatattttatctgatattagtataaccaattcagatttatttatgttacagttgtcaagctatatatttttctatcattttagttgtaatctatttgtgtctctaagtttaaagggtatctcttatagacagcatatagttgaattgtgtttcttttgttttgtatttaatccattctgccaatctctgtcttttcttgtgtttgaagtgtttcatttgtttacattaagtatagttatatgctaaactaataaattatatcttatgtctatcattttgtttctttttgatttgtctgtgtcttttttctctgttcttctattagtgtgtgtgtgtgtgtgtgtgtgtgtttgtgtgtgcgtgcgtgagagagagagacagagacagagagagagagacagagagagagagagaaaggatatattttatttttatatctgggtaacatagttaatttccttactgtatttttttactgtctttttgaattattttcttattgttgtcttagtgatttcggtttctaacaatctaattcagattaaaatgctacttaagtttgtttccaaaatagttgtttacatgtagttctagttattccccccttttctgctattatctcatacaactttttatctatatacagcctattcccatcaacagagatgtgtaagtattgctttatgccgttgtttttgaaattagataaaagaaaaaagtagttgcaagcaaaataatacatttgtaggtcctttctacttagatacatgtttacctgtaacagtattctttttttttttttaatttaacttctattttaagttcatgggtacgtatatgtgtaggtttgttatataggtaaacttctatcataggggtttttgtacagattatttcatcacccagttattaagcctagtacccatgagttatttttcctgatcttctttctcctctcaccctctaccctctgataggccccattatgcagagtcgagttcttgtgaagctttctttcaattcttactctggagatctctttagtatttcttgtaggacaaatctgttagcattaaatatcaccagttcctgtttacgtaagactgtcttaatttctccttttctgtagaatagttttcttggatatgcaattcttggttgactttttttttttttttaacaaaagaagaatagagaaaaaaagggccaaaaagaatattagaagacataatgatcagtgataaatactaatctccacattcaagctcaataatttccaagtaaaataactcaatgacaactgcacttagacacattataatgaaactgttgaaagccaaattcccactgtgcatgtattggtatacatgatggggtcccacaggtgtctgagcctctattcattttccttcatttgtttttctttctgtctctgctactggataatttcaattgacccatttgcatgtttactaattctgtcttctgccaactcaaatttgctcttgaatcttgagaatattttattccagttattttacttctcaactacagaatttctattttttattatttctatctctttattgatattctctgtttggtaaaacatcattcttgtaattttatctagttctttatacattatttcctttagttatttgaatgaacttaaagcagctaatttaaataattagtcaatctaactctgggcttcctcagagatagctcctatttaatgtttgtttatttcccttggatgtgctatacctttttatttctttgaacatataatactttttaattgaattctagatactttaaatagtataatatgccaacctgaaatcagctatcccccagttcttttgtttttttctcttcacttttgctgctgtttgattcatgactttccaggactaattttgtgaagtcagagttcgaagtctctgattggctagcttatgatgactaatgattgtacagaaattctacttgaacctaaaagcttccagtctttgctaagaggctctgtgtttttagagaacatccattcaatggttaagaaagcagttcaaaactatgacataggtttcatctcctgtttgcatagagccttaggattagcaagtgctggaagactgaggccttctcagttcttaacttgacatgtccagagtgctgggcatgtggaaatcccttcccgtgagtacaagtttctagatttccaggaatataatgtagcccttgttcttttaagtgttttagtcaccttttcttctgagcttatagctcagattatccctttaaatgttttgttttccccaactgttattgctgcctcagtcagcaacagttttgaaaaattgctgcttagggcgggcgtggtggctcacatctttaatcccagcactttgggaggccacggtgggtggacctcttgaggtcaggagtttgagaccagcctggccaacatggtgaaattccacttctacaaaaatacaaaaattagcctggtgcagtggcacatgcctgtagttcaagctactcagaggttgaggtgggagaatgttttgaatcgggaggcagaggttgcagcctgggtgacagagtgagactgtcttaaaaaaaagagaattaaaaaaaagttgctgcttaatatttttgctgttttaacgaaaacctccagggtagaggctaacctcactgatcagcactgagtcgtatcaaataaaaccaatccttgtgagtggaattttcaaggctactgcaaaacagatcacataataaaaataatgacagttaattgagaatgaggcattggaggagctccaacccggtttttttgttttgttttgttttgtttttctgtttgctgctaagatgctggttgtaaatgtaattgtgagactgttagttttcaaagccacaatggaactagggatggggtggtaataggacaagctacaatgtcacaaagttgctattcttactgtgattcagccatcttcttaaggaaatgctccctggattatggaagctttcatcgaaattccatagttctgaaaaagtagatattgacaatttttgccatcattttctttgtttaatgaaggacaggacttccagaggttcttggtcttccattctgactgatgtcttccatatgcattttaaacgatgatcaaaatcagtggtaataatcaacaaataggataaatcaaactttccagatagtcacgtgcagcaacaatttccattggtatctcctgattgcccagcctataggcactatcacaacggaaaggcagggccataaaagaaaccagaatcccccttctttgcaatgctggagttacttttctaccctgagcacagcttcaatttgataagaaactttaaattgcaaaagataagattaggtgtttattttaaaaactttattggctatttgttacatttacttttctatatgcagtttagagttacgtgtcaagttccataaaaattcctacaatggttttgattgagatgcactgaattcctagattaatttggtgagaactaatctatttacaatattaagattttccatccatggacattttatatcttgcatatgtacagtttttaaatgactcttagtaaagttttatacttatctttataaattttttgcatatttctttttagatttagttgtaggtccatacagttattgtacctgttgtgaatattttaaaaatcaactatattttttattattagtgttgggtttgggctgctgatctattatctaatagatctaatagatgctgatttactagatgtctacttttgagtttcatttttaagtgctaatactgtttttctaatttttctaaggcttaatgaaattattacatttaacaaatcaatgacagctttacttcttactttaaaatctatgtgactccaatttactttttgaatttaaaacaatgttaaaaattgtggcgatggtggcatcctcaactgtttttctattgaaaagttttgttgttaaggtatgttacgttttgtatatagtttttatcaggctaaggaagtgtctttatattacaaataactttttaaatgaataaatgctaagcttcatcttttttcagaatctgtaaagatacttctcttttaatctggttattaaacaggttgctacttaattttattaataccttttcctcctaatggttgattattttctaaactttgaactaaaaaaaataatttttactctctgttcccttaaatacactgctggatatgatatgccaatattttaaattgttttccatttttatacataaagtgaggttaatctgtaatgtcattttgttttgatgtattttctcgtgttagcattgattagcatcttaccatagtcataatttctcacacctttattcacctttgaattataaactctccagatttttcattgctcagaaattatgggtctcagtaggtaccataatattaaacgaagagatctaaacagtgcttttaaaagttcatttctctgcattcacaaatttatcttaagttaatattcagtatcagttactttaatgtagagatccatttctaatgttcttatatatagtcagtcattacatctcttgtatttttataatatactcaattttcataaatggatcatgggacattaattgatatctctttttggggtcgtaaacaagacttttatttctacctgtatgatacaatgcaggacatgaaaaaggagatcgctacctttccctttctcttctgtttttaaattctgagataaattttatccttttgtgtgttcagtgtccatagcagtgacaaactaacttatacttaagatatgtgagttagatagctggtttatataaagtacattctttaaaagagaagataagcagaaatgagattcatagcagggaaattctaactcttcatccaagaatcactttcttctcttctgaaaaatgaaacacgagaactttcacttaacacttacctccataagaaactcacaaacttagtaaaacatttgttcatgaactcttattatgtgtgtgaaaacagtggcttatgtatccagctttaactatcatctctgctctcagttcatatatagtgcaaggaactcccaaagtggtttctacttcactccagtgggatatgaaagtaattctttctaccaaccccccaaaaaattatgatagaaagagaattaacctagcaaccaggacatccaattaaccttctatctttatcactaaatgtagtgagacattgggcaaggggcatttttatgtctccaaatactccttccatataaaatgaggggtttgaaatagacacctccaaggtctgctccatatgtagaatcctatgatattgtattgattagagccataatatgtaagtgttagttgatagcttaaaactggaagtttaacctttatcttagagacacatttgatgttgaaattagctgatatatatttgaaagagcttagctttgatctagtgcatagactcaaaacagcatgatgtcttttaaatataacttaaacataaaatgacagtctgaagggagaattactgttaggtccaatttttaaaaaggagtgtatattgcaattgcatcctttattaaccagaaactcagagtccttataaaatgtggaccctagtttgtctgttttattctaagaagagtcttatacagagcttcaactaatagttgtaataaagtataattaagaattcaagatttaccacaaatatataccttttgtgtttgtgcttgtgtgtgtgtgtgtgtgtgtgcgtgtgtgtgtattagagacagggtctcactttgttgcccgagctggagttcagtggtgctatcacgactccctgcagccttggtctcccaggctcaagtgatcctctcacctcagtcacccaagtagttgggatacagatgcacaccaccctgtccagcaaacttttttaaatttttggaatggttaatttttaaatattgtgggtacactgtaggtttatatagttatgggttacatgatatgttttgatacaggtacacaatgtacaataatcacataaggataagcagggtatctatccccttgaacatttatcctttgtgttacaaacaatccaattatactcttttagttatttttaaatgtacaattaaattattattgactatagtcaccctgttgggctagcaaataataggtcttatttattcttcctatattttgtactcattaaccattccaacttcccccccaactgccccctcactacctttcctggcctctagtaaccattcttctactcttatctccatgaattcaattgttttaatttctaactcccacaaataagtgagaacatgcagtttgtctttctgtgcctggcttgtttcacatatcataacaacctccagttttatccatgtggttgcaaatgacaagatgtcattcttttttactccactgtatatatgtaccacactttctttatccattcatatgttgtcatattttctccctccctccctctctccttcccttccttttttccttccttccttcctttccttccttctatctctcttctctctctttctctcttccctctctttccttccttcctttgtttccttccttctctctctctttctctcttctctctttccttccttcctttctttcttccttccttcctccctccctccctcccttccttccttccttccctcccttcccttccctttccttccttccttcctttcttccctctctcttctctcttttttctctcttctctctccttccttccttcccttcccttccttcctcccttcttttcttttttctttttttttcttttatttttcttttctcttattttctttctttctttctttttttggtagagatgagggtttctaccagagaccatggagggtctctccatctcgcccaggctggtttcacactcctaggctaagggatccttctgcctcagactcccagactgctgagattatgggtgtgagtcgctgctcctggcctagccactccattcagccttatttttaaatatttattgaatttaaatactgaataatatttaataagtattattcaatatttattacattgttaagcacttaaatgatttaagactaaatttaaaacttgtgatttcctttaattatgatgaagtaagattataatctgaaagaatattttatttaaaattatgatggatatctatataaatgtaagatttactgaccaaaaatggaattcattttcaatgtggatgttatttccctatttgttaatctgcagtgtgatgataagtttcccattggcttttatatttctttattttttcctttaattgtatttatatgagaaagataactagggacttcaattaggacacattggaggggtcagaaaccacataatggaattaagtcatgaagtttggagatagaggcattccaagagtggagtgacctttgagaattttgtggtggaagtgaaatttatataggtctctattttgattttagagtagaaatagtgtcgtgatagtatgatttataataagaaatatgtatttgatcttcaaactgttttctggcacccagcttcttaaaagtcttgaaatctccaaagtgttaagtatcttttttatatgctaattagaggactgatggctgagagcttctggataccttcaagatgggaaccaaaggagctgaaagttgagttgaacatccatggccaatgatttaatcaatcatgcttaggtaatgaaacctccataaaaatacaataggactgggtttggagagcttccaagttggtgaataagaacatacccacatttgagagggagacgtaactatatgagggaacagaagttcctgagcttggaacccttccgaccctctgaatctcaccctatgtacctcataatctagttatttattcacatcctttaaaatattctttgtaataaattggcaatgttttgggaagccaaggcaggaagatctcttgagtccaggggttcaagaacagcctgggcaacatggcaaaaccccatctttatcaaaataaaatacaaaaattagccaggagtagtgatgcaaacctgtagccccagctacttaagaggctgaagtgggaggattgcttgagccaggaggttgaggttgctgtgagtcatgattgtgccactgcaccccagcctggcaacagaacagagcaaaaccttgcctcaaatagtaataatgataatataatataatataatataatataatataatataatataatatattgataatagtaagtagagtgttgccatgagttctgtgaagtgttttagcaaattcattcaacctgaggaggaggtcattccatatttatagctatttggtgcgacacacaggcaaagcaacctaaggtttgccattggcatgtgaactgaagcagtccagtgggactgagtatttcatctgtgagatctgatgcttactccttgtatatagtgtcagaattgaattgaattatatgacagccagttggtatctgctggagaactggttgttggtggggagaaatctatacagattttggttaccagaagtgaaacattgcattctgtattgagagttagaacagaaaaagtatttttttttaactctcttacagtacaaacttagaataaatttatatcttaaaaaaaccatgtgactcagaaataaaacagcaataaacaatgaacaaaaaatccagaaacagacattatctaagtaacttgttacggtttgagtgtgcctgccaaacttcatgtgttggaaaaacatacaacagtgctgagaggcagagcctttaaaaggtgattaggtcatgagggctcttccaccatgaatggattaatgccattatcactggagtgggttattgtgggagcagattcctgatgtaaggaagagtttggcacccttccctatctcttgcacatgtactgttttgtccttccaccatgggatgatgcagcaagaaggtccttgtcagatgaggcccctcagtcttgtacttcctggcctccagaactgtgagccaaatacatttctatttattacagcttatgcaatcttggggattctgtaatagcatcacaaaacagactaagccataacttgttacctaaattgaacttactgacatatctgagttctgtaagtattctttgtactataattttcacccatttacaggttgtaacttcctaagacttagagagttggcaagtaaaacagttgacttaaaaagtgtgttgtaatttgcatttaagagccaagaaatgtacccaaaaaagagaaatcacctacagaaaatgtatgttttttttttcccttgggttggagtctctaggaaaaagtccttaaaactataataaatgaggcataaaatgtgattgtaataaagcctttgtcaatagagagagttgcaaatagtaagatgaaaggttttccttcattttctttctcctgatctgtgatgagtatataatctagtcttagttttgttctcaaatcgtaccaatggttttaatcaaaattcacttaagggtgattatttaaaaataaactttcgaatgatgtattgtgcattttaaacactctcacctatcatcatccaggaaaatgtatatatttatatttttttgtctcattaactactttcacattttgtcttctccagccagaagttttactaaagtgatggcaaagaagaaaacagatgcccagaatgaatgtgttacaatatattgcacaatagtgatagcaaattccacaaagcaaatcagtgacagactagcctatttttttgttactccattttatattctagactccaaactatatgtaaaagaaaataagtcataaaaatctaaagtagttacaaatacaaaaagaagtaagtaaggtacacgtaaccaaataagataaatgagttaaaatctaaaacatattaatttaaattctgctgaaatttagtaaagaatacatgatcaaaaacaatataagaaagaattctggacctgacatttcaaatgccaattattgtagtttatttaaattaattgatttcaattactcagaattaaccttgcaattaatagttatgtacgtatgttttatttatttatttaaaattattttcttattcaaaggattaaaaataagctcatctgcattgtacatttaccttaacattatataagataattgttaaaaaataactctataccgccttgtatttgaaaaggaaatacaattacttatcaattacacaaaaatagaagttattttcaattgcacaaaaagatgatcgcacatatattgccttagtgtcataataaacagcccaattatattatttattgttctctcaatagcagagtagaatcttagaaacttgagtccaggaaacgtgcttgtggatttcaagttgtggtgacttcattaaaataactattagattgtattattagaaatagattatttcttccaccattttttcctttttttttttcttgtacttacagtgggtggactttatacacttttcagtccgtttctcctatcctggacagtgaattacagactctgaagcagatctaaagcaacagacacaattgtaaaagaggaggtatgaagttcgactatataaaaatgttaacttattcaaacttagtactgcctgtgatctatcctcaagaaggaagaatgaggcagctacaggtcagaatgctgcaagtaatttgggaaatgttaaaaagaaaaaagagaggaaaaaagaaaagcttcggaagaagttatatcaggaagataaaataatagtgatgaactattctacattgtatcatccattacacatgccaaaatactataacgtatgaaagactcttgtcaacatacagtaatgtgatgactgatactaattagacaggttttactctacacataagtctggctcttatagttcttgctactcataaacataaggggttactgattcaatgacaggcagaatttcctgctgaaccagaaagaagataatggtttagagattaaatttgaaagtgttaagtgggagacatattcaaaacagttaacactgattaatatttttggaggaagaaaatgtttgtattaacatgacggtattatagaaagcgatagcattacttattgcttcatttagttatttactaaacaacagggacatctgaactttttcccaagtggaatgaatttatcttccctcacgctttttgctaagaaaagcactcccacgagaagtgatttaaaaagataaatacaatcaggatattccatccaactttttctacaaattaagtcagatagatgtagaagacaatacatgtacctatgtttaaaaggatgattacaaataaaaacattttatgaaaacagaaaatctcagtctactcaatgttcttctaaagacaaattgttcatagcaccattagtcataactcaactaaatttcactatgggtttccagtgcccgcattcttgacttgttcctttgaggcaatataaaagagagattttacaacgggcttgtaaaacatgaggtcttataggtattataagttactatacatatgtatgtattttgagtttaactgtttcagctgaagaaatatatttacttgatttttccctttattactaacatttacctcctacttagaaaagtagacctgaaaaaataagaaattagaagtgaaatattcaaaaatgtcctcattcctacacatttgtggttgctgtctataaattgttttcactgaaacattttctcttggatttaacactgataaggttcacctggaaccccacaaaaccctgatagactacaatcttttgtctttatacagtttacaatgtgttttttcataaatgaaacttcagtttatctcatcaggaaaactctataaattatcccaggaaactgaggctgagagaaatttaactaatttatttaaggtcctaactttgtttcccatgatattatccatggaacactgactttacaaaggaaaagagtaaaggcaaaaattgcagtcaggtaaaagaaacaaaaaaaatgtaatctttacttattttcgggaaaaccagagaatgatgacatttattcttaattatatctaacttgacttgaaatagtataactctccttttttccctctcttgacaatagcatgactctacactttattactatatccacaggtgctagaaacagcctctggcgcatagtagatactcagtaaatattcacacaattaacaagttgcattttgtacctgtaaacctctaatattttaaaacgtcaactgaattaagtgaagtgttgaaactgaactgctcatattcacaaattgtgaactagacattgtttaatcccttcagtgctgctctattactgtcactctttgggatgttaatgaaatatgttaatatgtcaaacatcctggatgaaaagtaaatgtgaaatgcaagatgtgtattatttttctgactgcaaatgcaattgagcacttctgttaaatatgattcatattttgtctaacacagaaaatccctcacgtttctattctctcacactatgcacattttaaatacatcttaaaggatcaaaaagcagctaggtggtatgatatttattttcctttaatccattgttatccctttacgttgcatggctattcagtattttcctcaataccttgtagtattttaagctgtacttaaagaaatgcccttgagcatatcttattttcatatgtagtttggtagactgttacaattgtgcttattattttaagcagaattcatatgttattgatgaaaataaaactggccccatttaaaagtatcacggcagttaaagtttatgataagatgtgtgatgagttggtgtgattgaatcattactgaatagagacataaatttccaatagtaccaccacacgggactgaaacatatagaacaggatgtctggccatggggtgaagggaagggcgaagtgtgtgttctctctttcactaggggaatgtttctcccaccaaggcctttaacactcacagactgcttttccctatggttggtgtccattaatcttaccacctcctgcccagctgagtcagcatttacagattcagcactttctcaacaagcaaatggctctttagttgttagatcttgcccaagagaaacaccctgcacagtgggaaataatcaggcctcatacatttacaattcaaaaaggttaggtaacaatttcagtcaatgtaaataggcttctttggacactccttatcgcctagatgatcttgatggtgagaatgatatgaatgtttctctaccaatattaaaattttaattcctcataaaagaaacacaaatagctaaagatgtccatatattatcctgttgtaaaataaaccttctcatactatatacacatttttgagtttcaggtagttttgatttattccttttgtaaatatttaagaagattattctatttttctgctaataaatgtttaatctactgatattcccttttcctcggatggaaaaatctcaacggtcttttggacagtcttcaatttctttcaaaaataaaagagtgtgataaatcagctgtcatgtattggttaagaaacaggcatttttagaaacgttacagattccttgatagactaaatttcaaatatttcacctatattttcacctaactgaaaacaaaattttctaagtgcatgttttcacagattgccggagaataagcatttcattaattgatcctgggcttaagactatatctttaaaatttgtactacagttttgattataaatttgacagctaaatgtaaaagacatataaccttaagagtacatcttactgtagacagagcaaagaagcagatactttcaaatttatggcattcccttagtgtgtaccatgtattcgactcttaaaaatagttttctacagcttccgttttatattccttgatttagtatgttccttaggttgataaaccaatccttgagagcaagtgccataccttgctcatgtgttaataaacatagtgacatctcgcataaatgatatgtaataatgtttattggatttagtgacagggaaaagtgctctctggccttgccattacgaatgcatgcctctactaatcactctcaaactttagtgttagggattttttgcaagatgcttgtataaaatgcagattcagctgtctcatatgcagttattcttgtttagtaggcctgagtatggcttcagaatctgaacttgtacaaacatcatgataatactgacacaagtgtttcctgaagagtgctttgaaaaatactgctttttaaaagttaagcatgttgttcttccatgagtagatccttgaattctttcagtaggctaatttttaagacaatgccctcttacatatgtattgctccagggatgcttcacatgcccgtgttttgcataaaataaggcagagagtctttgaatctgatgcacagttgattgacaacttgtaatactggaaggtcagcactaattactgagcctcatttgcatgcgaaattttgaaagatggaaactaaagtgtctgtggcattttctgccaataaattacctgcctgacaggaaggcgtcactgctcatcaacgctggtagtgtgtaagctggtacttgttcagttaaggagaagagaaatagtgcctcagagagttatcttcctgggaataattactataggtgtcaacaggctggaaaaagaagggagccctttgctagtctgtgagttaagtttgtgaatgatgaaaggtctgattgtaatgatcatcaaaatctctatcccacatctaggtttgctcatttgtcactgattataagagcatgagaaagagctcaggaaatagacagtaattaggtggttaagaacaaaatctctttacttactccatggattcctgagacacttctaagatgaggttactgctctgaaaggtaatgttttggggtagactgcaagagccaacaaaaaggatgaagtctgcattttctggggccagaatatttggagcacctgaggctttggtttgtgtctccatagaggtttgctaacttcctttacaaatttagaactgttctaagtcaatgtctttcctctttgctctactgcttacaggttctggtgctggctagaagcatcctttgattttcataaacttttctttgtagccatcaaatagcagtttggagccccctcttggagacggaacatatttgaatatttgctaggagacaactgaagcctagggatggtaagtagaggcctttcatctggtttacatagctcagagttcactaccatcatcaacactgatcacttcagagttctgtagctctgttctgtgttaaccctctcagacccctatggcctctgagagacctgacccctactttgagacacactgaactggaaataataactcccatatgggagaagaatactccagccccaagagcttatcaagctttgttttttctatgactactaagaaaaggagtgtgtattggaagcaattctctcagcttatagctattttgataggggttctatatttaataaaggttaaatccattgaaactgtgagtcaaaggcacttttcatgtccaacaatttcacctactttagaagcctgcctcttcccactctccccatgcttgctcaaagcgaaaaatgggcggcattggttttgtttagtaggcaaatggcccttcccccaaagaatatgaataagtattttcaatctgaacttgtgcatcactcttataagtctctctcctctacacaaaagaaatctctttgtagtaattgcaagacttaattagccagtgttcaaacaaaggcatcctttgttcacctatcaacagcctgctttcatcgatagttccctgactctctgaagactactctttttctaagttttgcagacttgtattttcagctttggggtcctttgatataagtgctcgctttcctctccccggtgtcttttcttggcctcatccccactgtagaaaactccttcatggttggtggtgatctgatcacctttccagtctgctaattcctagtcttcagtagtggtacagaagcagatttttgaaacagcagcaatgctgggggaataacgggccactgaaagagttgaatttcatttagttccatttttttttttccttcttcaagtcagagctagagcaatagcagggaagggtgaggaattatgagcacctgaaaaatactagaaagataagccagtgaatgcactgtaaaaatgtaagctctgtctcctttaagaacaaaaggaaaaaaaggacatcatatataattccacaggtttaaaaaaaagtttaaatcacttattagctaatttatggctatcacattctgagcattaccagatattactctcattgaagttgccttctttctctcctctgcttatgtaaatcctactcaaacatttcatgacactttttatgttgacatttaaaaggcttatgtcctagagattgctgttttctttcctaggtaataatcttaaaatttacataccttttggagcctgacatctgtagactcaaatctataatgtttctgccactaacttaaaaaaaaaacaactcagagtctcagttgttagtgcagaggaagttctcactgcccttaagtaatcccttcagaaaatgtacctattatcatgattattcctacctcatggtaagtgatgcttgtaatttatatccttaaagctcaatatctatggcattcataagcgtagatctccatatcaaatagaaggttttcaaaatcatttattgtttctatagagctctctattaaatccgttaagcagaaatattaatttacattaccacgacatttgaatttgaaagataattcatggcttacaaaaagatgttttaaaataataaacacattcttacaataaatttgcactcagtcatcttgagttgtcatcagacactactgcaactaatcaggatgttcttcacctgtttcaggagagaatttactaactcttccaaagtttaccaatgcaataccagttctgacaatttcacagatgttagattccaagtatcgaatacaaaacaaaacgaacttgtgttttagcttttccaatgaaatttttatgattcccagaagacgtttgtttaatttcactacactatctcatcaattatttgtgtgctacatgccctatcacagttacaactctacttctccctaacacgacttcaagaacacagtgtacatctctcgtttatcatgaatttgcctgctctgaccacttttctgaaagaagtatcttttttccagttcagaaaaaagccacttccttgatcttcagatatttctgcacaaaaagattttgtttactgatgaacttatttgtataagcaactggcctcatttagcagtcatgatgtcaaatcaactcagtgtaaaatagcaaactgtgtccgcccatctatacttgatttcttcttttactatctgccctatgatatcaactgtactctattaagttagagtacatactcttctagtttattgcagaccttatttaattaacatttaaagaaaacaggtataaatcatattttacttttcttatcataaaaatgataatctctggaagaaataaataccctcaaacaatagtaagcagattactaacaacattctgtatttatttcaaggcagctttctatcaaggttaaattcagtttttaaacaaactcattagtgatgatttgctctacatttaaacctccttaaattctcaacttggttaatattttctcaagtattatcaataataaaccattttggatatcaaccgtagaaggagaaaaacaagccacgtgttatgaaaaggacacagcagtattcttgatcttgaaagaccttcagtacaatgcaatagttcagtcataaatccattagaatataacaataaatataaggaaacttataatacatgcaaaaggaataataacaaggtgagaacattgaggattggggtggtcagggaaaaattacgttttgttaagtcatataataagcagactctaaacaattgtgaaaaattatcgtgaaggaagaagaaacagtgagtttcattacacactatacataagtgattttaggcattttaagagtacagatttaaagtctacttttctagtttaccaagtttggtttaagtagtcatttatattaaaaagttaatccttaataaaattatatgaacatttaattaactgaattggatttaaaaactctttttagcatatactcttccattggttgagatacagtaatacgcttaaattaaaagtctattttcctttctatcttgtaatggtttgcaaacttttttaaatctgaaagtcctattactctattttaagtatgaataagattcaaaagaactttcctttcagttgttacagtatgctgttccagactgagttgatttgacatgctgaaaatccattcatattactttcaaattcatttaagacattaagacaaacaaatctgcatttttacttcattaagtaatttacagaaaatgatggattttaatgctattttggaaactgaaacattcaactagaacaaaaacttctttgattctatttgattagagataacaaggaaaataaaacgacgtgaagagcagaaatgctgcaaaaagacatatttatcagcttggcgctatcatctgtctcttaattttgtcgcataaaaatcattaacgttactggccaggcatggcggtggctcacacctgtaatcccagcactttgagaggcggaggcgggcagatcacttgaggtcaggagttcgagaccagcctggccaacatggtgaaaacccgtgtctcctgaaatacaaaaattagccaggatggtggtgcatgcctctagtcccagctacttgggaggctgaggcaggagaatcgcttgaaccatggggtggtggaagttgcagtgagccaagattgcaccactgcactccagctagggtgacagagtaagactctgtctcaaaaaatatatataaataaatgaaataaaaataaacaaataaataaaataagaccgtcaatgttattacttaaatctgcgcacattgaatgaaaaataatggaatttgaaaaacagtcattttactgtgcgttttaactgccttgatttcccacctccctgtttccccccttcatattctattaaaaaagcactccatctattgataactacatacaacttctaattttagttctattttttcaaactttagcgtataaagctttactgggtgcaccatttacttctcccaacttcttgggactcaggatctttggtctttcctcccatctttatcaaaacttgctccgaataaatctggttttatagtgacttttagtatcctttcactaggggactatttaacctaaattaataattttcaagcataagttacatgggaaaaaggtcagtttttggttgcaggaacatcctaacacccattaaaaactctctgtgtaagcagttacttactggcccggcacagtggctcatgcctgtaatcccagaactttgggaggcctaagtaggcagatcacctgaggtcgggtgttggagaccagcctgaccaacatggagaaaccttgtctctactaaaaatacaaaattagctgggcatggtgtcacatgcctgtaatcccagctacccgagaggctgaggcaggagaatggctagaacctgggaggtagaggttgtagagagctgagatggcatcattgcactccagcctggacaacaagagcaaaactccatctcaaaacaaaaacaaaaacaaaaacaaaaaacagttacttactttacgtaaggcaagagattaggagtgaatttaagcttcctatacaacaaaatgtaaatattgcatagtatagcacctgagaaaagactaatataaaactaaggcaaagaggatagacacaaaaattcatcctaaaatatgtatagagacactttcacttattaaattaataaccaaatattaattatagatattcctgagaaataaaatattttattaaaaataaacagaaacaaagataccattccatggttacatgttcggataagacagaaaaaagactaaaatgatgcagaattagtaaatctagtactgaagtttccaataagatgggctggtgactgtctataattgaataataatactctaagtacatgtttaaagttaattatttttcatattttaccacttttcacaaaaatcttttgagttagatagtgaaaatgctatgctttccattttactacaaatttagagcttttcaaggcattaagaagatgtgagagagaaacagtatggatttgaatgagatttagtcttaatcacacatatttagcaaagtttttcaacttggaagaaatagaaagcggccttatccaaaacctttcatgatatctgtgctgtgctgtacacaatcggctgttgattctcacaatagcctgtctatgaaacttgtgtggtctatcttaggaagccaaaagagtgagataatgacaatagcacttattataaaagccacatttttgatcatcctatttgtggtttaaatttccctttattaagaaaaactggctgatgtaaaatcacttgctagacagtacagactcagcttccctctcctccaattttccacagaaccactggccaccacacacattgctgtcaaattgttctgtttcttgtcagctgcacactgggcagaatagggggctggttatgcactaattaggagggtggacttatttaaaagtttcattctaagaaatatagctgccaaatattagcttatcggaaagttttttgaggagaaaaggcagggatagaagaactacaaaataaaattttcatttatttgggccaggatatggaaagaaatttgtcttgagaatggcaccaatattaaaggaaattcttctctgaaactagaaaaagctgcagtattgtccacttgaaactgatgactttagaaaaaaaaatgcaaaacattctcatgtgaatttgactaaattgctgtttttttctgaaataattatagactaataaaggtgctaaatttataggaaagacattaatgtagcttgacagaaataacagtgtaaacctgtagtatattgaaagttcccacaacaaatttatctgttaacgttgttaattatgtatggagagtgccataaattgaagtttttcccgatttgaaaaaattgacttgtgctaaattctccttaacatgtaattaagacatatgccaagggttattttaacatatcatatttatgattaaagaatagtatgaaagtaaaaaaattgactaagagagtatataaatgactaaaagattatataaataatctatctctgtatgtacatatatgaactctaagtgcatatgaataaatacaaaatacaagagaaagattatttgcatacacattaagaacagtcatcctctgataatgaaacaggtgatttgcttaactgtattttatatgattctccgctgggaacaatttacttattaatgactacaatataatgttttaatcttttgtttttgaatattgagggattttaaagcaccgagcaaactaaactgagtactaaataatttataatggtactacagtaacaagaaaagaggcttatgagttcatatttgagcataaattttacaattttaaaatgaaacatgatcgtgacagaaaaaacaaaagcacttctttcctgcctaatagtagattagaagcactaaaaggatttagggtggcaagaaacatctaatgtttgaaatgatatttagtagccaagatgcaaatatcaaaatgaacttcagtgaaaaataccctacattttaaagatacttgtcacaatgggccatttagtaacacaaatgacaacttttagaaataaattaactaatacattttactgaaagtatacaataattctccatatagctgttctttgtgttaatcttggataaaacctgaggatgtagagtaattcaatgaagtggggtatgtacactttttagttctgaatagctgagtaactgaattgtgcataaaactgactaagaatcaaaagccatgacacatcaactaaactatggaaattagcaatcttattcttgataatatattaaaaaagaggaatcaaaatatgacaataattaacagtggcattgttgtgactacaagctattgagttattgtacaagatagaattaaacctgtggttcattaggaaaggagttagcataatggttttattgaaatcgttgtaatgaaagacaatttcacacacagaaaatatagtttgagttcatgcagatgttcatgtatttaaaaattaaattaaatttataggtcaacctgctgttgattctgtgcatgattttttcttaatttcaatatacgaaaaatttaaatttaaaacaatataaaagtaaggaaatgtggggaaaaagactcatgatcataccacacaaactgtattcatattttaacgttttaactaatgcaaatgtaaattaagtgtaaattttgatataaatgtaaagcaacattcaaaatttaataagcattttttattacttatatataggttatgatgagatacttaagattgaaatattacaaaagtaaattttaagctaaattaaacagcttaaaaccagctgaaatgcataacttggctgaagttgcatgacactggctccaggggctcatcaaggctctatctattctctctatcatttggctttacctccttctctgttgcagtttgcttaattcagctatgaggaaaactccataattaaccaccaatgccctgagccccacatccttccatctaagaaaccccagtggaaagagaacttctctattcaaagcacactcaataaatcaggaaagaacttgcatggttcttgcttaagttagatggttattgtatctaatgaactggactaataagtactgatcaatcctgggtcatgtgccacaattgctgaggattttttttttttttttttttttttgaaacagaatcttgctctgtcactcgcgctggagtgcagtggcacgatctcagctcactgcaacctccaccccctgggttgaagcaattctcctgcctcagcttcccgaatagctgagactacaggcacgggccaccacgcctgggtaatttttttttttttttttttttttgtatttttagtagagagggggttttgccatgttgaccaggctggtctcaaagtcctgacctcaagtggtctcccaaagtgctaggattacaggcgtaagccaccgtgcctggccaatatttctaaaagaattacaatgaacacagaatatgtagataggtggaaagagagaacaactacagttgtacaaagaatccaaaataagttgtttctgattatttatttttgtttgcttactctctttatattagcttatatttggagatgttcaaattttaggcttttatagaaagagctagtgaggttttgtattcatttagtttactatttttttttctatactgaagaacaattaatactgaagatctgctttttaaagctggagacaaattattagtaaaacttcctgagcccaagataatacccaatagatcttctctgattgtttcttgtttttcattattctttttaaattttgttaatccaattctcaaacattttgcttgacatagaaatcattaattttgctagtattattaaattgaataattatgtatattatttatatgtatttattttattctctttcattatatcacctttcacaaatatatgtgtttaattttatttcttggtttgttttgcctatgattgatctatctgtggggtttctgtgaatatgcatttgtaatctagctttcagatttctttctttttccttttttctttttcttttcttttcttttttttttttttttgaggtggagtctcactctgttgccaggctggagtatgcagtggcgcgatctcggctcactgcaacctctgcctccggggttcaagcgattctcatgcctcagactctagagtacctaggactaccggcgtgcgccaccacacccagataatttttttgtacttttagtagaaacgggatttcaccatgttggccaggatggtctcgatccccccttttttttttttttttttgagatggagtctcaatctgtcacccaagccggagtgcagtggcgcaatcttggctcactgcaagctccacctcccaggttcaagccattctcttgcctcagcctcccaggtagctgggactacaggtgcccgccaccacacccagctaattttttgtatttttagtagagacggggtttcaccatgttagccaggatggtctcgatctcctgacctagcgatctgcccaccttggactcccgaagtgctgggattacaggcgtgagccaccacacccggctggtctcgatttcttgaacttgtgatcttcccatctcagcctcccaaatagatttcaggtttcttaataaattattctgtctatatattttttaatgcatattttgcatttaaatctacaatttttctataattgctatctttatgtttttcttttcataaaatatttaatcaaataattatctcacataatttatctctcttcttgtcttctattccatgtttctcttctccttgcctttatttatttattgggattttctgtatagatcataaggtactctttgaatagagattatcttaattcattctttccaagtcaaatgacttttatttatttttttcctgccttatgcacagaaaaagatattaggtgtgatgctgaacagaaataatgatagtgacatcatgccttgttcttgatattaaagagaagtacttactatttcagtgtttgctgcaggcattcatcaatatataaaagctttctgttcctggtttgctgagatatttcatcacttgtagttgttgaattttgccaaatgctttttctccatctattgagatgattactttttttttcctcctgttgatatggtgaattagtttgattgaagtatgaaagttgtactagattttcatttctgggataaattcctcttgtttctgatgtattaaccttttgatatattgctagattctatttactgatatttttaatggaggagttttgcatctatattcatgagggattatgtttcatagtttgttttattgcagtgcctttgcttttattatcagattatgctagcttcatgacaaaaatgagctggaaagtgtttcctcttctattttctagaagagttttttttcagaaatgatatttttttcttgcttaaatgtgtgataaaatttacctgtagagctatttgatcctgaaaatttctctgtgatatttttcaactaaatattaatttataaagagttatggggccattcaagtcattgcttcatgggtgaactttggttgtctttcaaggatttgtccatttcactgaagttgctgaacttaagagcataaagttgtttatgatatccttttttatagttcaattttcttagggcttttatggatatctcttctttctttgctgctgctgctaatttgcttcttgtctttttttttccccttgagctgctaggctacagttttatcaattttattgatactttcaaagacttgaagtgggagcagactatgccactctaaaatgtgccactttggtataaggattattttgagctaaaagcacttcaaaaacagcaaatgtaagcaggcattcatctctcacgtttcttcctgaaaacagaagataaaaactcccatgttaaagatgtccttcctgtaccaggagaaaagaaacattcttcggtggggaatcatagccaagagaattctgaacaatgagaccttgttaaaacaattagtatcttcttttaacctcccctatagtttagttacttttcaaaaactgcctctctttgttcaacttagaataaaggtatttatgtttcaccagttttttgtgtctttatttccttatagtggctcctgtgtcacataaattttatataaatttgtatgcttttcgtatgttaatctgtcttatgccaaattatcaggcccagccagataccctaagaattaaaagtttttgcacctacagaaccatctttttgtttctttttttattgtatattttaattttacttattttcttatgatacttattctccctgctttctttgaatttaatttattcttctctttatttccaaaaaaagatttagattactgatttgagactatttttctcttctaatattagtgttaatgctataaattttcccctaagtatttttagcagaatatcacaatgttgagatccagtatttttatttccattcaatacaaaatatcttaccatttttcttttacttctttaacccatgaggcatttaggagtgtgctgtttaatttacaaacatttgaggagttttcagatatctcagttagtaatttctaaaataattgcactttagttaaagtctaatcttatttgatttacatttatttaatttgctcagatttagtttttggggggcccagaatatgacttaacattgtgaatatcccatatccataatgtgtattatttttaagtacatttaaaatgttcacagtggtattctaggctccatattcttggctgatagttttagacttaggtcaatgttattcaaagtttatcaggatttgggttttgctgttgctatagttacctgcaatttgccattggcttcaaattcctttagattttttcttttatttttttgacagggtcttgttccattgctcaggctggagtgcagtgatgccatcactgctcactgatgtctcaacctccagggctcaagtgatcatcacgcctcatgctcccaagtagctgggactacaggcacatgccatgaaacctggctaattttgtttactttttgtagagatgaggtcttgtcatgatgcccagggtagtctcgaactcctggcctcaagtaatcctccaacctcaccctcccaaagtgctgtgattacaggtgtgagccattgcacccatcctagaatttcttatatgtgcatatttggccacaaagttttcttctaagtcttcttcactctcaggttcaggatttccctttatgtgtatgtctcataaagcgtttgtttgcgttcttgtcttttcataagaaatagactgctgttgcttgatacttggtacttgctatcctctattgagagacagggggtttcttctgctgtcctagtttagtctcaatggttggcaaaccctgtattcctgggtctcagggattgagactattctcattctggggctgaaggtcacttctaaatggtcctatttctcctcaagtctttggaattgtctaaagagattacctcaaaattttgaatctgatgggttcagaaacagtaatcattttacagattataatgatttctccttttgtgagagtgggagttacattttttccagcttcctataccctaagcagaagccagaagtctatccctttcttttaaataataaataatacttccatgtattttcctttgagtacatatttgaccttttatcatcagtttttatattttaaaatttgtggtccatagtaatttttaaaatttaatgtctgtattaacagttcagagcttatattatttttccttgtttgtatttctgacactgtgttggttaatactgtgtcaacttgattggattgaaggatgctaaggattgatcctgggcattgctaaaggagattaacatttgagtcagtgggctgggaaaggcagacccacccataatctgggtgggcaccatctaatcacctgccagcacagctagaatataaatcaggcagaaaagcatgaaaagactagactgtgctagcctcccagactacatctttctcccatgctgggtgcttcttgactgaacatcagactccaagttattcgttttttttttttttcttttctttcttttttttttttttttttttttttttttgagatggagtctcaatctgtcacccaggctggagtgcagtggcacgatctcggcttactgcaagctctgcctcccaggttcacgccattctcctgcctcagcctcccgagtagctgggactgcaggcgcccaccactaagcccggctaatttttttgcatttttagtagagatggggtttcaccatgttagccaggatcgtctcattccccctacctcgtgatccacccacctcagcctcccagagtgctgggattacaggcgtgagccaccgcgcccagccaagttattcagttttggaactcagacttggctttccttgctcctcagcttgcagacagcctattgcgggaccttgtgatcatgtgagttaatccttaataaactcccctttatatatatatatattctctccatatatatatatatatatatatatatatatatatatattctctccatatatatatatatatatatattctctttatatatatctattctctttatatatatatattctctatatatatattctctttatatatatattccctttatatatatatatattccctttatatatatatttaaggagagaatatatatatataagatctctatatatacagaactaataataggacatatatatgtatatatatatatatatatacacactctatcttgagagagacagaactaataataggatatatatataggattatatatataggatatcatatatatcctatatatactatatattagtatatatataacaataagatatatgtaggatatatgtaggatatcctatatatatactatatattagtatatataataatagaatatatatcctattattaattctgtctctctagagaaccctgactaatacagatactataagtatttgctatcattcctaatgtttttataataagagcaagtgaaacatgcaatatcttctatttgcatcagtatattaccaatttttaatgccccttactaattaatgagaatttttatgcctcaagtaactaattttcaatgacactgaaaaattgactgaaattcaataacaaaaatagtgttaaaactaatgataactatattattcaagagcttaattatagggtgaattcaaagtgagcattgaggtacagaaaaaatgtattttattctagaatatatgcttttcttatataacgtaacctatattcaaagattttttaatgtaagttatatacactgttgattattattgaagttactgttatctagaaacccttaagatgcttaaccagctaaaccagtctgtaattgttcattttggaattggattttattgctgtcccttagtttatctacaaggagatttgctgcatttgatttagtttcaccttgttgaggccttttttacatgctaatattgtcatccaaaatactatcccttgcagcttcatatcaacttttatttaaataatcatattttcataagcggtgataagagttaaacagaacaggactgagaaaaaagccttatgctctgccactggaaatgtttccttaagttgacattattttataaataggcatgtttgtatattcctatttcatttattacaaatctatagtctcaactcaaagctacttgctgccatcttttcctcacatattatataaatgatctggtttaaagccattttgaaattcagatctgtctcgtgtatttcaagatccatttaataatttattctgaaattatacttgtgacttatgtgtatgtttggagaaaattactatagtagattgattgcaaaaatggcttaattcactactcctccctttatgcgtaccttttgcattatatatatattttttctttttctgtgtctttttccttttttttttttttttttgagacagagtctctgtctcccagactggagtgcagtgtcatgatctcggctcactacaacctctgcctcccaggttcaagcgattctcctgcctcggcctgccgagtagctgagactacaggcccccggcaccaagcctggctgatttattgtatttttagtggagatggggtttcaccgttttagccagaatggtctcaatctcctgacctcgtgatccacccgcctcggcctccgaaagtgctgagattacaggcgtgagtcaccgtgcccggccctgcattatatttttacagcttctttaattaaggggtactctctgttttattcctaaatctgggtgtaaaaattgtgctttgaccaacagaatgtggctgaagtgtcaatatgacagatctattcctacgcctcaagaagacttgagtactagcacggttccctggaattctgcctcataatgacaacaagcccaggatagccaactggaggatgggagaccaatggagcagagctgggttgcccagcggaggaggctatctggaccagctagttgaatacagacagattagtgatcccagagaagttatctgagtctgggcctagattagcagaactacccatacactcatgaaaaataataaatgtttgttattttaagccattaagtttttggcatgttttattgttcacctagataactaactcattgattaccttttatgaaaaaggaaacaatgattcatatggacatttgttgacacatcttccactcaaatgattattcagaagtcatctgtaagtctatatttgatcttgtcaacaaatttgttactctaggcttgaggcgacatatggtttatctaattttgtagttgtgatttatttgtagtgacactatcaagaaaaatcataggagtgatttacttccttataaatgacttttgcaggtataagataaggtagtaattgagtacaagtgcaatatatttattatttttgctttagaatctaatgtaatttgagtatgattaattttcataactataatcacttccaaggtatatcaaaggtaaggacactatttacattttctcttagtaattactattaaaataaatttatattacttggaaaggagggaatatcattttttctctcatatttgtttattaatatgtattcattttctagattaactagttattatcataaacagactatctgggccctaagatgagtggggagatgggagaaaggtcagttgctatgggaaatgatggggggaaagtacgaaacacaatctcaggagtcatcagtcttccttattagagaggttggggtaaggtcattggttgtcccagttgggcaattctatgtaggcaagagtgagccacaaagatttttttttctcctatatacttagtccatggagctataatttgtgtattgattgtgctttcttttgtggaagaaatctattataaaagatagaaaagaaacagaagtgtaggtgttttccaaaattatggcataaattcagaatgttttagattactgcatttgtcatctaaaacatttgtgtcaatttgtgtttgcacatgaatctattacttctacctatgctttgtataatgctcagtttattaagtataaagaactactaagatgttttctctaaacattttaagactatttacacaattaataaattaaaaattccaaatgaaattttaaacatctcttagatatttattgactactgacttagtggaattctcctaaatattttaataaaataatagctttgtgccaccattcttttaatacttcaaataatataaaaataaacaaaacatgtaaaaatatcagatgatccaaaatttcttgttatatcggcttaacctactaaatagtacccagaaactctaaggataccacccagcatttgtctcacatgccctgcaggtaactttaataaggctaaaattttagaatcacctgcctatgagatacttcttcattggtagcacatctattttttcctccttttgttctcaactgagctttaccatatattttaagtttacagaaacattgcgtggaaatgacagaaagttcccatatgtcctctctgctaagtctgcatgattagtctcttgaaattgccgaaatattctgtggcttcttagtctggaataaatgcatcattaatagaatcttatatctgtttaaataaataaatcatgtgaattcgaattttctagtatttttttctttgttattttgcctagttaattttattaaagttaataggtagagtcctccaatttctgtcatctagaaaagaaaattggccaaatatatgtttttcaactattttcccataatcctcctgtttttactcacttaagtgcatacctctattctccactgaaaagaaagtttcttgggggtttattttcaccttactcttcacttacagcagctcatgtttgcattaactaatgtaaagatgggactgtactgactaaacttaattgaaacaaaacatgtttgttggtctacacttctgtttttgtaattgtggcttttttagaaaatgtctggtaagggttaaccaaatgccaatttaagatgtgatcggaactgaaggaaatgatgtctcaaaaattacgtcctgataaagcgtatccttatgcaccaaatagagtccaagtaaataattcaaagtcattgctaaactgcaagtttgagctgcatagtaaatgcagatggaaatcacttaggtaatgtaactggagattaagaaatgtatacttatatttgaaagatatttctcatttcagattgaaactgtaaaatgtttctttgatgttcatgtaactttgattctaagccctttcaaatcttatacactgcaaatcaacttatgaaatgaatactcagaatcctatagttctatatcctgaaaataaatatgtcttcctctgggccaataaatgtaaacatattcagctgaaactgaaattccaaattatgactacattcaaacatctttctgaagattatatataaatcaaaatacccagatatacatttagaaagatgtttgaataaaatcataatatttatatatgaatatatacacagttatacttacagtgtgcatatctttttcttggaaaactttttatttaaattaaaatagttaaatggtttttttaaaagaatattatttttgatttatagattgtaattgctttacctttgaccattattttatggggaatgtaataatatagagaattaacactgtcgagtacaaaaactaaagatttaaacagatagcttttaaatatacatgctcctatttcctgcaaatgttatatattattttacatttcattctttttagcatgtgagctatatgatgattttaaaccttttgatagaccagcttctgccatgaattttctgttggcactaacctccacatttgctcttctgtgttgtttttatcactgggtactggaaggtgggaaacttattttccaagctccattgccagctgatttctggttaggttctacctaaccatctaacaaagggatgcactacgtcagaggttagaaagtgagataaagacaagttagttgttcctggttcttgcagtggcagaaactgcagggaaccaccataggttactagggacagcagaagtatcggtggttctggcatggatggtttcagagttgctgtgatccaaggttattagggtgccttcagcagcataagtaattgtgattccagcagcactggtaacagcagctgcagctgatgtaagtttctccatgccggctgctatgggacctctagaagctctgcaattttattttctttagttaaaactcacctctctcatgtgctactccaacactttaagacatttaaggccacgtctctctctgggcttttctctgctctctaaaagaatttctttttattgggctagaaaatgacttataaatgagaaaaacttggcttattcattggaacaattcgaagataagacagggcatacacagaccacacactgtgaacaacatgacttgacatagagaatagagttttcagtgttagtgttgaggagatcattgaagataagtctcagtagtagagtcaactaacatttgataggacatcatctagtcttttctaaaaactgatgttaagaacacgtagcatgacatctactctcaacaatttttaagtatattgggaagactgctatattagaaatgaataagaaagaccttttgttgcataatagctatcttactgtgcatgtgtatttttgttacatctactctaaggattcacttcttaatgggataccccttgaatatgttaaatacccataaacacttaagctgtggacttagagccagtatattttgttctaagcccaggtttctcttctgacaaattacagggatatcaaaatttcccattcctcatctggaaaatgaattccctaatccaaaactactttgcagagcctttgtcaggatcaaatgggataatgtatgttaaggtgtttttagaagggctgaattctgcatgcatgccagttattattgcagaagattacttcacagctggaaatggaaggactgtgactccaaaacttaaagaaggtggctcttgaatcaaacagtgactctgcacatagctacttacatagcttctgtgagcacattctcttctgtgagctgtgaagtcaggaacagccctggaataggtgagagatccatgagacaaatgataggaaagagggaagcacaggcaagagacatgaattggccattgttacaaattatcatcattgtccttctcatactcaatcaggtggccttagagctgctgcttcttgctcctgtgccctgtgcattgtgcgtcctgaatgcctaagggttgtgcaagaaaaatcaaagtttatgcaatcaacattttggaaaccttattgcacatcagagccaataggaaaatcttcctaactaaagattcaagtatatcacccttctatttgtatttactagatacagatgtcacctaagattctgaatgattcgagtgccccagaaaattcatctgaataggtctgaactaaagcaccatttctcagatgtatgacctctggaccaatttaattgaaatgatcttttttacctgtttaaatatctaatttctaagcctgagcccagaccattgaatcagagtctctgaatggtgggtcctggagcctataatttaacaactaacccaagggtttgtaattcatacttaattttggcaactaagactagtgggcaaggtcaccacaaggccaagttctgcacctgctctctcaccccctgcaacactctcactcactttgcatctaattttattgcatccaaaaataaatgttaaccttgctttaaaccaaaattaaagacaactaagtttaaagtgaaaatccactaataagtaaataatggcattggcttttctaagctttacctagctctttcctggtttccaccatagccacttctgcggttggcattatccttccatatttcagggttcatttcacttgaaataggtttgggactcatgcagtttccataacctagaatgttccattgactcatttatctggttaactcctagtcgttattccaaattcatcttattgccatctctaaggaatattttctagtctctgaagtacaggttattcactgccttgtatatagaatccagaaccctttctgttacatatatcacatactattataaatgtctatttatttgtcttagtctccgtaagtctcctagaccaggttcagcaaactttttctgtgatgtgcagatagtacttattcttggcttgcaggtgattgggtttctttcataattattcactctgtccttgcagcatataagcagcaacagacaataagcataaaaattttctgataaatttttatttacaaaaatagtcagtggaaggtgggtcttagtttggtccatgagtcttagtttgctgacctctgcactaggctgttagctaaacatggccattcttatttactattgtggcctcaaatagaacagttcctggccaatgataagcacaccatacagattcattgcatgtaatgtgtaatttgtatagaatttagttcagctgctaataaacaagcaaacaaagtggtttaaataaggtgtagaagtttgtttccctatcacatgaaagaattttggaggtaagccaggcagggttgataaaaaaagcttcagtgttctccgtgttttcagtcatgggctcctgttggtgtacatactctaccattcttaccatgtggctttcattctcaaaaggacttcattcatgcagaaatgaggaatggaggaagtacatttaagatgacttcctggaagtctgacatacgtctatgtacatgaaattgtccaggacttagtcccgtggacatatttagctttaagagaggataggaaaagtggatgtttagcaagaactactgcgatcagctaaaaatcgatgcccaacaacaaagggaaaaagagaatatagatgttggtgttcaacatgcatgttaatgactgattttggttgttgcctggtactttgttccaatattatgtctatgtatcagtaaactaaccccaaatgtcatctaccccaaatggctgaaatgtggcagaggcaaagagcaaatccacctcctagtgttcctttctaccttctgattgtgctatttcataaacagagaagagagagactcaagcactttccattttgattttgtttctgagtggcaccagaagttcataagtgagtgaccttcctaaaaattgtattttgtgattaatgcactcatacttaatctcttgttctacacttcaggaaaactaaagcaactgctcttgtgcatgagaggcagcctgaaacatgcataattacaagtgtttacatctgtttccaaactctaaaccagaacacagaattactcttgtactggggcttgcacagtggtctcatttgtttatttactttttggttcttgaattatatgtaaacatgcacaatgacaacaatgttataatatctgacatctgtcacatggtgacgttagcacacaggaagagattttggttttctttatgaagagtggatatttgatcttcaccagaagaattttcggattgtaggcttaaaaaatagaaacttgttaaacttacttgttttctattaacgagtccctttttcttctcccattcatactgtacttgaacaaatggaacaatatgcttttctctgtctctgaatttctgtcccttctctggctctatgtgtgtcttgtcttcctcttccgtctctatttacctatctacatacctacctgtttttagacacagacattagtaaataagtgaataattataaatctgatttgctttagatattatttcaatactcaactttattttttttattattatactttttcctttctttttttattattattatacattaagttttagggtacatgtgcacaatgtgcaggtttgttacaaatgtatacatgtgccatgttggtgtgctgcacccgttaactcatcatttagcattaagtatatctcctaatgctatccctcccccctccccccactccacaacagtccctggagtgtgatgttccccaccctgtgtccaagtgttctcattgttcaatttccacctatgagtgagaacatgaggtgtttggttctgtccttgcaatagtttgctcagaatgttggtttccagcttcatccatgcccctacaaaggacatgaactcatcctttttatggctgcatagtattccatggtgtatatgtgccacattttcttaatccagtctatcattgttggacttttgggttggctccaagtctttgctattgtgaatagtgccacaataaacatacgtgtgcatgtgtctttatagcagcgtgatttataatcctttgggtatatgcccagtaatgggatggttgggtcaaatggtatttctagttctagatccttgaggaattgccgcattgtcttccacaatggttgaactagttcacagtcccaccaacagtgtaaaagctttcccatttctccacatcctctccagcacctgttgttttctactcaagttttacaggacattaataattccttgatttgataatagaagaatttaaactttctacttcttggctcaccaattttattaatgtggccatgtgtaatttgagggagtgaagaccttagactattgttcttatccttaggttactagtgcttttttcttaataatatattcaaatggaagtacccattctataatccttattattgtgtttatttttattcctcttccattcccttacatttgacatttatattaataaataaagcattgatgtttattatgagaagatatttcagaactatcagtggtcctctaactttagggtacagaataatcacatgtgcaacttgtgaaaatgcagatcccaggtctttgtttctagagattctgatcaagtacatgggaaatgtgactaacaaatctgtactttaaattatgcagggtctgtggttcatgcctttataataatggggcaggtatgttttaggtatgtttgcctgcttctgtttatatcattttcctaatgtgaagcataatttggtgatatgtgtgtgaatgtgtactgtttctgttacagtgggttttggaggtattttctttcctctcttctagattagcaactttcttttcttgggctgctgctctgaagtgtctcctccccactcactttcctccccaactcccagtttacttcatttatacctggcactatcaatgctaaagttctttcagcagggccacttcacgtttgccacctagaagcacatggtaaaattcagataatgacagaatgtagtgatgctggcttgcttttcattcagttatggttttgttatcttccttttcattcccttgtatttctacttcttcctgcatagcatgtgtatgtgttcttgtctaccttgaaatttaatacctatgaaagcctaaatgttgttagattctaatagattttgagccgggtgtttttttgtttgtttgtttgagacagggtcttgctctgtcgcccaggctggagtgcagtggtgtgatctcagctcactgcaacctccgcctccagagttcaagcgattctcctacctcagcctccctagtagctaagattatacgcacctaccaccatgcccagctaaattatatatttttagtagagacggagtttcaccatgttggccaggctgatcttgaactcctgacctcaggtgatccacccgcctccacctcccaaaatgctaggattacaggcttgagccacggcacccagcccagttttgtataaaaataagtctagttttcaccttaatttcatttcttggtgtttatgtcttacagaaatgcaatctcctgttgtacaaatgtgcctaatcataaaacagttgcgtgcagtactgtacttcaaagtgtatttcaagttattcactgtggcttttgtgacagattctttcaaatgatcatgctttttgaaaaacagttccttttatgaacagataaatatatgtctatcaaatacaaaacttctaatgtaaaaaaaaagtctaaagtgttttcttaattgtagtctattttattttttctctccttgaaaattacatggattcttttaagaattaaaatttgaggagtaaggtttttgggggattggttggcattacagaattattggcagttggggaatattgaagattgcctctaacacgcaattaaacctggataaatgttagtagatagttctacctggttgtgtatcttttttagccttggtaatggcagagggttgtaagaaatggcactttttaactttaagaatctttttaagaaaatggtacaacatacggtaatgagctttcttgatgtgggctaagaatagtaaaacaagttgccattgtcttctctgtaagtgtcagatacaggagtgggctatgctccaatttttgcaggagatgacatatctagaaccaattccacactgggaatattagaccaacaacctggaatgagaacaaatcaataattttttctattgacaagggcagacagactctgaaacttcttaactcaattactgggccacagtttctaggactggactacaaaatagggttcaacttcaacgaaagcaggaagatataagataaaaaatgtttctgtatttatatgcttgtatgcatataatcaatatgaaaaacttattaatggctagccattagtttgcatgatatttaaaataacattctgtagagcccctattttaagaaattatgtctttatttgaagtaaggcaaaggttaattgaaaatatatatttatatatttttttttaccaaatgtatgttaatctatatcatttgttgttcacgcatttcttcctttattattattttttagtatatgcatttgaaaaagaatggagacaaggtaattacacacttttcatgagtttgaggaaaaagtccgcttatcaagagttactagttattcaagggaaatggcatgctgtataaattaatatcttcatcataaagtaaatacaagggaaaatattgttccaaagggctaaatttcagcacggaatgacctcttaaagagaggtataccacaatcagccaaatcaaagtgttcaaaacaattttgtagtattctgaagaatattacttctgtagatatgagaaaagcaggctccatgctttacagttaagcataaagttcacaaaacctctaaaactgaatgctgctgatgacataagtgcaaaccatttaaaaacagagaaactatcaggcaagatatgttctatcaagcctccttccctcctgtggaaaaataaaatcaaaaaaagaggtctccattattttctgtgaaggaaatgattccacttttgacccttacccactccttcatgcgtatttttcaaaattatttattcttttgccttgctgcttttacttttatttgccatatatctttcttattcagggacaaaagttaacctttacacacatcagcttattttctatgtagcttgtttattactttaaaggtgacataaaataattagttcttttttatgtgttaaatttgttgaatgaatagtctacacttagagtttctattttttaatatttattatttgatttgtcacctgtgtgtagtcttcaacacacttcttttaaaaagtcaatgtcacccgatttccaaatgcagtaactgtctttgagtccttattcacctggatttttgtgtcatcccagtattgatgcaactccatccttttaaaagatttattttcttgggtttcactgggtagagttctctgctaggtctgtctctatacaacttctcatgtaacaaattccttccttcatttttcaaattatctctatcttacctggccctcatatcatctgctttccaaattcatgacaacgactaacacttatttttggttcaaccacaaatctgtctatgcagttccaatcaaaatgagtcgtattctcatattttcatctgcatggtgtcatccctcagcttctatgtagggatagcaaattctacacgtgctgcttgtttttttattttttatatttatttatttatttatttatttatttatttatttatttatttttgagacagagtcttgctctgtcacccaggctggagtgcaatggcgcgatctcggctcactgcaacctcagcctcctgggttcaagtgattctcctgcctcagcctccctagtaggtgggattacagatgtcaaccacaatgcccagctacttttttgtatttttagtagagaatgggtttcaccatgttgaccgggctggtctcgaattccacgtgcttcttataatcacctacattaccatattacaaactcaaaaattcctgttaaaaaaaaaacttaaaagcttcccaatgtatataaatacaatgtgtaagaaattggattcccactttttctatctacagaatacattttatcaacatagggttctactgattcctctgctgaaatttaactttaaaattttgctacatttatgatactgtcatctattgctttcatattccctatatttacatatatgtcttttctcctttcgaaattgaaaaatcatgaaagacaaatcaatttctctttcttctaattctcctagcccagttcctgacacacaaatatttaccactattatggcttaaattttaagtatttttctgaagctgttagatatttaggtagtaagtaaatggttcttttaacataaaatctatgtaatagaacatacagggtatttaaaacataaaccacctcctttttctccctgaaacttaacactaaagtttctaattatttattagcatgaatacaatcacctcaaaactcctctttgtataaccacaatattggcgttgaaggaatgtatagctatcttcctatggccgactgagtcaatggagcagcatgaaaaagtgtggaggcacagcacagcacaccagatagacagaaacaaatattttatttttattgtgggtttagatggttataacccattggaaagaaagtaaataggcatggcatgctttaaagctcagcaacaagcatatgaaaaaacactcaatatcactaatcgttagagaaatgcaaatcaaaactacagtgagaaaccacttcacaccagtcagaatggctgttattgcaagctcaaaaaataacagatgctggcaaggttgcagagaaaagggaactcttttttattttttattgttgagacggagtctcgctctgtcacacaggttgtagtgcagtggcgcgatcttggttcactgcaatcttcactgggactacaggcacccaccatcacccctggctaattttttgtattttttttttttagtagagacggggtttcaccgtgttagccaggatggtctcgatctcctgacctcatgatctgttagcctcagcctcccgaagtgctggtattacaggcactcaccaccaagcctggctaatttttgtattttttacaagagtttcaccatcttggccaggctggtcttgaactcctgacctcaagttatctgcccatgttggcctcccaaagtgctgggattaaaggcgtgagccaccgcacccagccagaaaagggagctcatatactcactgccagtgggagcgtaaagtagtttagccattgtggaatgcagtgtggcaattcctcaaagaagtaaaaacagaactactgtttgacccagcaatcccactgcagggtatatatccaaaggaatataaataattctgccataatgacttctgttcacttatgttcactgcagcactattcacaatagcaaagatgtagaatcaatctaaatgcccatcaacagtagactggttaaataaaatgtggtagatatatacaccatggaatactatacagccgtaaaataggacaagattatgtcatttgtaggaacaaggatggaactggagagcattatccttagaaactaacacaggaacaaaaaaccaaatatttcacgttctcacttgtatttgggagctaaataatgaaaacacatggacagaaaaaggggaaaacagacactggggcctacttgatggttaaggctcgggggaggaagaggttgaaggttaaaaaaaaaaaaaaactgttggattccaagcctagcacctgggtgacaaaataatttgtataccaaaccactgagtcataagcttacctatatagcaaagctacacatgcacctctgaacctaacataaaagttaaaatattgttttaaagaagctcaccccactgtgtatatagcactagacacatgattaatcttgaacctcttaagttgctctccctaaaccgttctaaaggaatcatgtcagtaaccactactaattttactgctgaactgtttctggatgttatttgagactaaatgacttaattttgaggaaatgttcacaagacataaatgcaagcaaaaaaaaaaaaaaatggtcaggttagaaattagaaatgtgtccatgaggagatccctaatggaagatttaattttgtatatgctttcctctcctcagaaggagaaatgcaatgtaactgatgtgaatatttccctttaaacttctttattttcctttatactcaaatttcatttttatctacatcaattctgatctaaggagtagcaaacagattatgcccctcagaaatgtatttggttcacatttctcgaatctgaactctcatctgcttctagtcatagctatagtaactgagaactagaccagtcataacagcagacaaaagttaatagctgtctttgcatatttgggtgctgcaccaagctgattttcattttgagaacgtggatttcgtcctttaatcagacctttaatggatttggtctgattttggcatatcttggcctcaacggtcattatggtaaaacttgagagatttttattagccaatatacacactgtttttccctagtataaacagctctttcataaaaaaaaaatctctaatttttaaaatattatcttattcatggtaggtagagtgccttcctttatttttcccagccttgcagcccatttcaaagtcctcatgcccaagggatattctacctgggaacctggattgctaaactatcaactctttcttctccaggaagagtttcagtatttttagatacagaggattgagatagagttcttaaaaacaatttatacctccttcagccatcatttatttagatacttcagaaaaagtaatatatttagctctctgctgaccctgctgtatgctcaggattttgtagcattctattgaaaacttaaaaacttaatatcatttctgtataatgatatttacaaaccagtgttgactatggaaagtccatgctcatctgcaaacatcagattactaagagtgtcacggccattgtctcaaaatcacttcattccagcttcaaaagttataatatatttactattcatatgtagtatatgagtccttaaatcataacttcatgagaattctcaccagtttggaaaattttcaaaaattaccagtataaattgttccacaacactgggatataagaaatatgacttaaaataaggacagttttgaaatcaaaggaaatatttctaatcttccacttcttgactaaaagaacataaaacgctagttatttgggggaatcctttcccttactttgtttaagagaagttgtgtggatttaaaggtgccccttctcctaaaggccacactgctctttctcccttccatggactacaggaaaaggtgatcacctattgagaagctgagtttaggatttcaaaatggtacctgcctaatggcaaaggcggctatggcccaaggcagagttaagagtgaaggggaagattacttggtgttgggagtagagactgtaacttagggaagcaaaaatagagagagttcatatgcctgtaattgtggaaaatacctggaagaaattgagtcctggggttttgctatagccatttctgtaacagaatcagcaaaatataatctaaaactgctcaaaccaatagcataaaaaaaaaccagattatcttgaagggtatcactcttcacccaaactgccagctagaaacctggaaaaatctcatctcaataccacccaacaggttgaactgatttccacgttgtcagcactttatgtatgatgctctaaaagagtaacagtttttaaaaaatataaatatttaccctcaagtaagaaaatacttgaaaattgtaagtgatattgttcaaggacacaatcactactgagagataaaagttttatattccctattgggctggtatgaactctttagctaagacccctaactcctgtttattagaatcctatcttgtagaactgccaggaaatgtctgcagtatcaccctcagacttttaggaacctcaacagtgaggcacatataaacaaacttacacgggtataccagaactctctgtctcaagtatactttgtattttggcattatatgtttccaggcatcttatttgaggagtgaagatccaggccaaaattccatatgttcttaccagcctgaccctaggcaattataagactttgcctgccaggcctcagggtgcagcgaagctgacctccttacaccagatttgtacatggtcagtacgttgcaattttctgaagggaattgcaattaaggactcatgtccgcatgagccagccatgctcagatgcatatcctacattcctgcattcctcaggtgactctgtttagaggccttttatcaggaggtgtgatggtttatattgagtgtcaacttgattggattgaaggatgcaaagtattgttcctgggcgtgtctgtgaagatgttgccaagggagattaacatatgagtcagtggactgggaaaggcagacctaccctcaactgggtgggcacaatctaatcagctgtcaatggggccagaataaaagcaggcagaagaaagtgaaaagactagaccagtgtactcttccaacctacatctttctcccatgctggatgcttcctgcctttgaaaactggactccaacttcttcggcttttggactcttggaccttcactcctggactgaaggctgcactgtcagcttccctacttttgaggttttgggactcagactggcttccttgctccacagtttgtagacggtccattgtgagacttcaccttgtgattgtgtcagtcagtactccttaacaaactccccttatatatacatctatcctattagttctgtccatccagagaaccctaatacaggaggccttaactaagactttttttccaattagtacttcactcctaacattctcccctcttctttctcctaatctttgagtccatagaacaatcaaagccttttgttcagagatcctcaacattgacaaggtctcccacctatgctgatccacccaacctttacctgtgccattctgtaaaaacaaaatagagcattaaaaagcttgtgcctatttttgccgcctgctaacactacctcagcaactgaaaagagacttgattgtcacattcagtttggcttgtcctacttgaccacctagacacctggaagctggacagtatggtgaagtacaccggtctttttcccagacactgctgaggattaacaaagtagctggggaaaattaattgggagcagggtgtgggagaagggaatgttccctctctttatccagcttgtggttaacatatccaatcaagttttaatctataccaagtttggccaactgcccacaagataattattataggatgtatgaattacacttagaagataaaagatgtaagtagcatgtgtctatacaaatacaaactgcatattcttttggtgtatattgtctttcttgagaattatcaggccactctcattgaatatctctgttgaaactcagccaattcttcatattgtggtttacaaggtatgagcagctaaagggatagaatgcagagaatgtcctccaattggcacgagtgagctagagcaatttttccttcagtgttgtggatgacactcttaagctgaagctgacagatggaacccagagaaaggtattgggaaagaaacaggagagataagcacattcttcagggttcctgtgtattagataaaaaaaaagcatatagttggctacccagaggccccctgcagttctgcaagtcatcgtattcatctgcagaagacattttaacaacctggattctcaaagacgactcatattgtcaggaaaggtgtgcactttccaagtccagggcattattccaatagacatttcccaaatttaataagcatacataaacaaatcacctgagaccttattccaatgcagattctgattcagtagataggagacgaaactttatatttctaagaagctctcagaagtgatgtcactgctgctggtttgtggaccatactttgagtaagaagttaatagcgtataatgaaaaggcaccctgtggacttgtgcgctgtacaacctgcaaaaatatttacagtggcccagccatctgtactcgaggaactggaaaccatgtgacttcttatatttttcataagtttcttttaatcatcaaaggaaacaaacaaacaaaaaccccaaaaccaaaatttctctcactcacacaatacattcttctggccgctgacccctttccaaaaaacagctctttgctagcctaaattactatttttactcaatggagaaataaagagagttttttttccccttaattgtatgtgatagtgaaaccattttctctttgcactggagttcggttctaccatttacttaattgatgtagttcatcaaaaggattagttattcaccatcactgaaatagggtcaggtaactctgctctgaataaacattctattattttgaagattattcagtgtttttcactctgttctctatggacaataggaatcagacgtatttccttgaactgaaaagattccagggtccaattctaactgcttcatatgaagtaaagcctctcatcagtatacatgtccagaggattatagctcacattctcaataggagaccaagttacttgttgtcttgcttagtgtgttttgtgctgctgtaacaaaataccataaactgggtagcttgtaaacaaaataatttttttctcacagttctgaaggctgggcagtccaaaatcaaggcagactttgtgtctggtgaaagaatactttctgacttatagacagcgccattctgctgtcttgtcacacaatagaaagagtaaggggtctctctcaggcctcatttataagagcactcataaatcccatttatgaagggatctactctaccctcaacccaatttcctcccaaaggccccaccttttattaccatcatcttgggggtgagtatttcaacatacgaattttgaaggaatacaaactttcagactataagcattcactttatgacatggcattacacatataatattaaggcttgcttcaagtcttctggtggctacctacacagctcttcattcttgcctggcatgaagcatagcttttagtgttcagctttaattatccacagctgacagtcatggaaagtgcaagacataaaatagctccaaagctagagagaatctaatttacatgagtcatagagcagagatgctttcagctataatggagtaagaagaatcatatgtattctctagtattacacaattaaaaacatggactatatatgtaaaaatgatttgcatatagtagacaataggaggcgcaagtcagtcatcctggaaggaagaaaaccaagcaacatgagccctgggattgcccagtagtagcaatagagttgagcatctgaagaggccaaacataaaacatttaaaaagcaaagaagagaagagaagatagctgcacagagagaaccttgcacagagagaactctggagatgtggaacagattctccttgtattaccagctgagtactgatcagcaaattctttcagggaaaacatatcaggctggagaaaaaaaggaggcagaataactatcaagactcgtatagtattggcaatagattacatttcctagagcaaaagacagcaaggagcctcaggtgaagtattcaggaagttactgcctctgaagttggaccaaattagtctaaaggtaaccttagtcctgcctaaaacagcttctaaatgaacctcagaagaatcaaactatattcaagtaatttgactctctcttacaacaaagatgaaaaatatttaaaggactacagagaaaaatctatcataaaaattaataattttcaaataattatcattcatttaaagaatcagaagtgcctaactcatatgacaaattcaatcaatagaaacgtgctaagaaatgatgtatatgataaaattactggacaaagacactaaaacagctactgtaaacatacagcttgtatccaaaaagttaaaagaaaggcatgaatatattaatgggagatgtggaagatagaaaaaataggcaaatcaaatttgtagagatggaaattacgaaatatcagatgacaaatacaaagtcttagatgacaaatacactggatggtatcaagaccagaagaaatactattgtacaaaatgttagtgacatttaagacacagaaataaaatctctttaatagaacacagagaaaaaaattctgaaaaataatgaaaaatatatcagtgagctacgggacaaattcagtcagtgaaatacgtttgatttaaagtactaaggaggggagaagagaaagaaattattgaaaaaaagatttaaaaatttacaaattttataaaatgttaaacttacctttccaataatattataaaacttaaacagaaaaaaaacattaaaaacgactctaagacatttaataatcaaatcctttaaaccagtgttgaagacaaaaatctgaaaagcagctggagcaaaccaatcaacaacaacaacaacaacaaaaaaaaaacaacaaaagccacattctatacaaaagaaaaaaaatagatcattatgttagcagacttcttattgaaaacaatgtcagaaataaaattagagaaatagctttaaaataaaaaaaaaatactggatgaacaattcaaagcttatggaataagaaaaaacttcaaattttccatacagaaaaactatctttcaaaaataaaagttaagtaaggacccagtcctggcagcattcatcacctgctaactgaagggcccttggacccagaataacaagcagtgatacccaggtagtacactgagggccttgggtgagcctctgagacttgctggctttaggtgagactcagcacattatcagttgtggtggatatggggcaaaactccttctgcttaagaaaaacagagggaaaagtaaaaggggactttatcttgcacttaagataccagcagggttacatggcagtagagcaccaaatgggctgttggggtccccagttatagagctgtactcttagacagcatttctgaacctgcctgggtgagaagggagcccactgccctgaagggtgaatcccagatcagacagcattcaccacagctgtcttaagagccactgggccttaaggaaacattggcagtagtctggcagtatttcctgtggccagaagtggtggcagatatggggtgaggctcttttgcctttggaaaagggagggaagagtgtgaaggactgtatcttgtggttttagtgccagctcagccacagtacaataaaacaccaggcaggcttataagttttttgactctagtccctgactccctgacagcacctctggacacatctggcatgtgggggaccttgctaccttgaagtgaaggatgcagacttagctggctttgccacttgttgattagagagtccaaaggccttgagagaacataggcagtatccagggagtggttaaagcaggccttgggtaggatccagtgctatgctagcttcaggtctgacccagcacagttgtaatggttaatactgagtgccaccttgattggattgaagaatgcaaagtatcgttccttgttgggtctatgaggatgttgccagaggagattaacattaaaggcagtggagtgggagaggaagcccatctaatcagcagctagcacaactagcataaagcaggcagaagttggaaggacttggcttgttgagtcttctagccttcatctttcttctgtgctggatgcttcctgccctggaacattaaactccaagttcttcagcttttggactcttggagttacaccagtgatttgccagggggttgggcctttggccacagactgttggcttccctacttttgaggtttggggactcagactggcttcctggctcctcagcttgcagatagccttcacctagtgattgtgtgagtcaaaactccttaataaattcccttcatatatacatctatcctactagttctgtccctttagggaaccctgactaatgcaacagtcatagtggttttggccacaggggtgcttgtggacacacccacctttaagtggctcatgtttggaagaaacaaacagagaagggaagagaataagagtctctatctgacaatccagataattcttctggattttattcaagacaatcaaggcagtacctctatgagtttgcaagaaccatagcattactggatttggggtggtcactgaaagcagacagaacttagatcacaaggaccaaagtcgtttcaaatatcaggaaagccttcctaagaaggatgggtacaaacaagcccagagagtgaagactacaataaataacaatcttttcaatgcccagacactgaagaacatgtactggtatcagcatcatccacaacaacatgacctcattaaatgaaaagcatcaagaactaattctggagaaacagagatatatagccttaccgacaaagaattcaaaatagttgtgctgaggaaactccaagagattcaaaataacacgagaaggaattcagaattctatcatataaatttagcaaagagataaaaataattaaaaagaatcaagcagaaattctggagctgaaaaatgtaattgacacactgaagaatacatcagagtcctttaatagcagaattgatcaagcagaagaaaaaattagcttgagaacaggctatttaaaaatacacagaagagacaaagaaaaggagtgaaacatcatgaagcacacctgcagcatctagaaaatagccctaaaaaggcaaatccaagggttattggcttaaagaggaggtagagaaagaaatagaggtaggaagtttattcaaagggataataacagtgacctttccaaacctatagaaagatatcaatatccaaatataagaaggttatcaaacactaagcagatttaacccaaagaagattacctcaaggcatttagtaaccaaactcctaaagagcagggatagggaaagaatcctaaaaacagcaagagaaaagaaaaaaataacatataatgaagcttcaatacatctggcagcacttttcaatggaagttttgcagcccaggagagagtggcatgacatatttaaagtgctgaagggaaaaaaataaataaactttaccctaaaatagtatatccagcaacaatatccttcaaacatgaaggagaaataaagactcccagacaaacaaaagctgtgggatttcattaacaccagacctgttctacaagcaacactaaagagagtattttaatcagaaagaaaaggaaattaatgagccataagtagttacctgaaggtataaaactcactggtaatagtaagtacacaaagaaacacagactattataacactgtggctgtggtgtgtaaactactcttaccttaattagaaagactaaacaataaatacatcaaaaataataactgtaagaacttttaaagacacagtcagtacaataagatatgcatagaaaccacaaaacattaaaaagtaaggggatgaagttaaggcataagagtttgtattaattttcattttgcttgtttgtttatgcaaatagtgttaagctgtcatcaggttaaaataatggattatatgacagtatttgcaagactcatgtcaaccacaagccaaaaaacataccatggagacacaaaaaataaaaagcaagaaactaaatcataccaccagagaaaatcacctttgccaaaggaaaacagaaaggaaaggagaccaaaaaaaaaaaaaagccccagaaaaaaaattaacaaaatgacaagagtaagtccttacttatcaataattacactgaatgtaaatagactaaataacaatcaaaatacatagactggctgaatagatgaaaaaaaaagacttatttatctgctgcctaaaagaaacacccttcacctataaatatacacatagaccaagaataaaagattgaaaaaagatattcaatgtcaatgagaaacaaaaaagaatgtgagtagctatatttatatcagacaatatagatttcaagactgaaattataagaacagacaaagacggtcactatataatgataaatgggtcagttcagcaagaggatatagctattgtaaatatatatgcactcaacctgagcactcagatatataaagcaaatattactagagctgaagagagagataggtcccaatgcaacaatagctggaaacttcaacactccactttcagcactgtacagatattccagacagaaaatcaacaaacgaacattagacttaatctgcactatagaccaaatggatctaatagatatttacaggacatttcatccaagagctgcagaatacacattcttttactttgcacatggttcattctgaaggataggctatatgttaggtcacaaaatgtatcttaaagcaataaaaaaaattgaaataatatcaagcatcttctctgaccacaatggaataaaactaaaaattaataacaggaggaatattggcaaatatgcaaatacatggaaattaaacaatatgctcctaatgaccagtgggtcaatgagaaaattaagaaggaaattaaaaaatttctggaaaccaatgatcatgggatacatgctgtaaaacctatgggatacagtaaaggaagtacaaagagagacgattatagtgataagtgcatacatcaaaaaaaaaaggaaaaacttcaaataaacagtctaacattgcatcttaagaaactagaaaagcaagagaaaatcaaatccaaaattagtagaaaaaaagaaataataaagatcagagcagaaataaatttcagtgaaaaaaatacaaaagatcaatgaaacaaaaacttggttttctgaaaagtttaacaaaattgacaaatcttaatccagactaagaaaaataagagaagatacaaataaataaaatcagaaataaaaaaggtgacttacaactgatactgcagaaattaaaaggattattagtaggtactataagcaaccatatgccaataaattggaaaatctagaagaaatggacaaattcctagacacatacaacctgccatgttaaacaaggagaaatccaaaacctgagcagaacaataacaagtaacaagattgaaaacgtaataaaaactctcccagtaaagaaaaatgcaggtcccaatggcttcactgttgacttctacgaagcatttaaagaactaataccaatcccactcaaactattttaaaaaacaagcgaatagggaatactttccacctcattctatgaggccagtattacctgataccaaaaccagacaaagacacatctacaaaagaaaactacaggacagtatttctgatgaatattgatgcaaaaatactcaacaaaatactagcaaactgaaatcaacaatacattagaaattttatccatcatgagcaagtgagatttatccctgggatgcaaggatggctcaacataggcaaatgtgatacatcatatcaacagaatgaaggataaaattcaatgttcatttcaactgatgctgaaaaagcatttgataaaattcaacattcccacttgataaagaccctcaaaaactggggagaaaatgaacatacttcaaataataaaaactatatacaacagacccacagctagtatcacagtgaatagggaaaaactgaaagcctttcctctaagatctggaacatggcaaggatggtcattgtcaccactgttattcaacatagcattggaagtcctagctagagcaatcagataaaagaaagatataaaagacacccaaattggaaaggaaaaggtcaaattatccttgtttgcagatgatatgatcttacacctggaaaaacctggagactccaaaagagaactattatgattgacaaacaaataaaatttcaagatacaaaatcaacatacaaaaatcagtagcatttctatatgccaacagtgaacaatgtgaaaaagaaatttaaaaagtaatcctatttacaatatccacacataaaattaaatacctaggagttagctgaagaagtgaaagatctctgtaatgagaactataaaatactgataaaagaaattgagaagaacacaaaaaaaagaaaaatattccacattcatgggaatcagtattgtcaaatgtttatattacccaaagcaacctacagattcaatgctatcactatcaaaataccaatgacattccttgcaaaaatagaaaaaacaattctaaaatttatatggaaccacacctccccaacacacacacagaatagccaaagttaacttgagaaaaaagaatgaaactggaggaatcacattacctgacttcaaattatgctataatgctatagtaaccaaagcagcatgatactggcattaaaaaaaaaaaaaaaaaaagatatatagaccaatggaacagaatagggaactcagaaacaaatccaaacacgtacagtgaactcatttttgacaaaggtgccaaggacatacactggggaaaatgtcatctctgcaacaaatagtggtgggaaactggatatccatacacagaaaaatgaaactagacccctatctctcatcatatacaaaatcaaatcaatatggattagagactttaatctaaggcctcaaactatgaaattactacaagaaaacattggggaaaatctccaggacataggtgtgtgcaaaaatttcttgagcaatacctgtggggtattaaatagaaaactcgtttttgataaaaactctcaggaaactagtaaaaaaaaaaaacaaaaaacaaaaaaaaaaaaaacaaagaggagagaggtaatttccttaacctgctataaaacaaccagaacaagcctacagctaactttatactcaatgggagatgctgatacttttctttgacataaagatcaaggcaagtatatataatttctgacttctgttaaacatgtgcaggtgttctccagtgcactaaaccaggaaaaagaaataaaacacattcagattgaaaagaaggaaaactgtctttattggcagataacatgatagtcttgggatccttaaggtgttgcttttctagccagaaacctctgtggccgttggcatctttgtccgagttttgctcaggcctgctgggcttgttccatctacttggcctggcaggctgcacttggcttgtgttatgggcccaaattcgacacctgccaagggcaaaccaggaatggaatggtgaggggtgcatgtgcaagtgagcgcagggtccagccactgtgcacagccaggcatgaaggctgctatggcggggcaggtagctccaggcaccggcaaaggtgccggctccatgcatgcatgtggctggatctgatgcactgcaagcagcttctgctgtgggcactcatgtctggacaaggggaatgcagtgacatccagaagcttggagatgccagaaactgcagagccccaaagagggtgtcagagtcctggcttggggaccccctaggtctgggacccctaaagggcagcagccctttttttctcattgcctgcaatgtggtaaccagtcacggggaggtgggggggggggggcggggtggcggtttcagccctgctttgtgttacagctctttcagtcccactattcagtgagtcccaagtttttgtcccatgtccagaaagaatgacatatgcagacaactggagagtaagcaagggagacagtgagtgatagaatagcccttcagagacccgaagtgggtagtttctttccacaggcaggtccttctgatgagcgcagcccttggtggagaagagacccagggtgggtatctgcaggcaggtcatcctgacctatctgtaggcaggtcgtcccaatgagtgtccagctctcagcagagaggagacccggagtgggtagagctcctttctgcaggcaggttgtcgtgaggagtgcagccctcagcaaacaggagactcggagtgggtagagctcttttttctgcaaacacgtggtcggatgggttaaggagactcaaattgggtagctccctctcacagctggtagtcagttatctctgtgagtctgactgtgtctgggatttttatggtctcagaagggaggaactgcgtgctgattggtccgtgggcagccgtgggcaggactggaaaaaagcatcgtgtaagttctcattgagggccgtggactccaactggatttgacagcctggccctcaggcttcagggatgacagccagcccccacgcttcagggcttgaggtggggggagggggcttcgctggggacccactcctttatgctcaggagcctatctgtctcctgctgccatcaatcaggttgtccaaggcacgcagagtgtttgtgctgaggggtgccttgcaggcccactctgagctgccctcagcacctcattggccttccttccatgcttgttagtgcctgaaacccagaaggggccgtggcagcagggttctgtcgtgtcagcaccgccctgagcatacagacaccagctgggttgcaacaaatgtctgggcttggcttcaactttgctctaaaattggagtgggcgctggcagtggggggagggcaggcagcaggagcaggcaattctgagcctgtcagcgggtcttcccaggctcctgagagcatagggatgcccgggtacacagctatggctgggaggctgcagctgtgctcaggaacatggggctcctaccccaccaacttggaagagggttcccacctgttcctggctcccgctggctccatggaatgtgcagccccagtcatgccctccctattgcagctggcatcttcacagtggccactccagatgggccaccactgccatcaatagtttatgtagaaattcctaaggattttcccacagatctaccaaaaaaggtagaggaaaaaataggtgagtttagcaaggttgcagaataaaagtcagtacacatacattgattttacttctatatgctatcaaaaaataactctgaattcaaataaaaataccatttgcaatagaacaaggatatgaaatacttagtaatcaatctggcaaaagatgtgcaagacctgtacactgcaaattgcacaatgttgccaagataaattaagaaacctaagtgaatggtgagtaataccacattcatggtttggaaaattccatatttttgagatttctgcttttccgaaattgatatgttaattcaattcaatcacattcaaaactagtcatttatcttttctttcagaaactgacatgctgattttaacattcatttgaaaaggcaaaccaactagaatagcccaaactttgcaaaaggagaataaagttggagaatgcattaattataaactatacttattttaaaatgaaaataaatataacaattctaaaactagagttattatcaaataaacttattttagctcattgtaaaactacagtagtcaagacaacatgactctgatgtgaagacaaacatataaattggtgaaatagaagaggaaatctgaaaacagtcccacacatatctgttcaattgatttttagaataattgccaagaaactccaatggagaaagtttaatgttttccacaaatggtgctataacaataggatatttatagacaataaaattacgcttagtccttaactcacactatgttaaaacatttactcaaaatagatcattgccctaaatgtgaaagctaaaataatacactttctagaaaaggaaactaaaatgaaaatcctagtgaccttggtttgggcaaatattttataaatagggaacaaataccaaaaacaataaataaattattgataaactggacctaataaaaatgtaacgcttttgctgtttaaaagacacttgagaaaatgtaagaaaagtcccagcctgggacaaaatattttcaagacttgtatctagaatatataaataacttttgcaactcaatcgcaacacaaacgacctttcaaaaatcatggtcaaaagttttgaatggacactttactaaaaaatatataaaaatgtcccactagcacatgtacacaattctgtttatgaattgttattagataaatacaaattaaaaccggaatgagataccagtacatggcttttaaaaagttgaaaattaaaaatcctgaccaaatcaagtattggtaaagatgtggaataattgaacctattgatatgaaatacttgaaaagcaaactaatctatagttataggtaacagaccagaaattgtctgggattggctgaagggtagaggatagggcagggagatcaggaaggaagggttataaaagagcatgagaaaccttttggggtggttgatattttcattaacttgattacaatgatacttctctaggtatattcacatgtcaaaagtcatcaagttaaattctgtaaatacttgccatttattatgccaattattcttaaataaagtccttttttatcccccacgaggtggagtctcattttgttgcccaggctggagtgcagtggcatgatcttggctcaccacaacctctgccacccgggttcaagcaattctcctgcctcagcctcctgagtagctgggattacaggctcccaccaccacactcggcctggctaatttttgtattttttagtagagacagggtttcaccatgttgatcaggctggtctcgaactcctgaccttgtgatccacccacctcaggctcccaaagtgctgggattacagacgtgagttctaaaaaagaaagaaagaaaaggaaaatatcccattggtaggaggtatgtctctgcagtttccaagccaactttgagacagtagcgccattataccttaagtcagtaataaagtcactttattatgctttaattgtcctaatcgttacgggggataaagtttttaaatttactttttaaatgttttagctttctaattttatttatttcttgtatcttccatcctcccactgaatttctgaagactccttcttgcccttaaatgttttggatgaaaaagtgatgtgttttgtgattaaaatcaagaacatcctaccaagacattatacattttatacaccactggaaattcatgtcataatgtaatttcttctgtaacttcaaataatattttttttctgcaaattatcatcaggaaatcttttatagggaaaattatctgtacttcctaaactaacaaaaagtaagtaacactgaactctctactagcagctaatataaaatagcaattgcttttaataaatcatcccaagaagctattgctggccttaatggagagctcattgaaaaacagtggacatgatataatgacaattgaattgtttcctttatttggtatattggctaagctttggttttactactatttagctcagatgatataaatgatctttaatcttaaattataaaaataaaattaaactatcattttctcaaatgtatatagtatatagataaaacacaaggttaggtacagttgatgaagtaaaggctttgaaactcttcagtgaatataacagaaataaactctcagttgtaaaagagccacaggtgctttgcatttgttttactccctcctccatatcccatttctattccacatcacttctcccttctcatggagacattttatcctcaatgttctggagtttccatgtttttttctttctttttttgatccaaaccttttctcaaaacttgatcatgttataaaatcttcacaaattacttcttcaagagagggcaatatttatgtcaaaagtctgaatttgtatttattattttgataggaaatatttatatcaaaaagtgagttatatagatattttagctttagtgaaagatgaggggagtcttttatttactattaatttattatgtggctagagtatcatgatgtggggtgagagaagtttggatgtatcaaataggcaggtggactttgctactataaatgaagtcacacaatatagttggtcctgcactctgcctgtgtggatggataagaaatataaagatgttcgttcctgagacctgaaaattaggtatcttctgatccagaagttgacctaaagtgtaattgtttgtaaaatgaaagagtttaagctgccctcctaattcacatttattttctacaggttttgtgaagggaaaagatgatatgattctattgcactatatcaattttgtagtaccttttatttatttatgtttactaggaaaaaaaaaaaacccaggtgacttctgaggccttcagaatcactgctctgagttcaactgacagacctctagattacatttgtattttcaaattagccagctttctatgatggttatctaaaaatagaaggaagaaaatgaaaacaaagttttttaaaactcccttgtgatatcaggtaataatttaaaaagttttattctcactctttctggagtacattctaatatggaatttgataccacttaaaattgaattttttatgggagggagaaataagatttccacatttcctttgatatttgcatattttatttcctgttagatttgattatgtttttccttcctgtttcttgaatattgattttctgtctctatatggaagaacaaacactgaatgtgcacaaaagaacactgctctaggttcttgagaaacattaataaatgaaacaaaaatattcctctgcaatgtacattctagagttttttcttgagtattcttagcaagcagagctaacatttattattttaggaatgctattttcagagaacactgaaataaattagattttattttaattgaaagggctctttttatctgcctcatgtctgttaaaatataattttcaggcaggtaaaattgtgactctcatagtaacatgaaatgaacagttgtcaaagattttatttaacccactaattaatgaggaatagagtaagatgttaggactaattcaaatgtgaattatcaagattgatcttctgtacaagattcatttgcattgccatgagcaggaatcatttccaggaaatatttgcattatttcgggttctccaggttaacttctgtctatcacagatggatacctctgtagaattagataatcccagaggagcagttatacaatgctcagcattccattcaaaggacactcagtgatctctttctctcatttcaaactcttgcacaaattttcctgacttagcatatttgccattatactggtgctattacaattttgctaagcctcattaaagtatcacacttgataattagaaaaaaaattttattatgacttttaaaaattggttcatctgaaattgaatttaactgaaagacaaaataagtgaattctagagacaaaggctttgagaattacttactttagactgcaattcatttgtttaaattatagcatccagattctcaaccaattagtggagtgagactccatctgaagtaaatgttgatgcctgggaggtaaagttgttaactactcccctaaattatcataactttagccaatttgaaaaaatacaacgaaaaaatttccttactaaattttaatcactctaaagttcagggtattatatcaaaaagtaatcataaccacttatctcttattttgcctcactgatttttccctatttatttttacaggtcaataactagagcatgcaaaataattcttcaatttcctgtgtgtgcttttctcgtgaaaccaagtagtttaagtactatgaaagtagctatattttgaattttatatttactgcttaaaagagtagatgtaaatactttttaaaagcagatttctttctaacagttgcttttgtttttcttggtaactcttgaatattgtcaatcctatgtcaacatttaagtttaaaaaaagctcttcttagattttagttttctgttacaattattttattcctattttagacatgactgtaatctgtagttttgcacaatttcatgacctatttttgtttatatttttctgtattatccggtgaatacatcagtttgaagagataaactttcatcctgtcatgagtaatacctactcaaaaacgtagcagtatcacgttacccatatctccccacatcaagttcagtgcagacccagtaatttctttctccctacaacaaaatggagttaatccatcttgtccactaacacaaagtacatgaaatatttcacaggcaattaaagtgacagaaaaatatataactctcgccggaaccaatttgggatgcaccttgtgagctgctttctcgggcacctctgcaccaactttgtttctctgctctgccactgtacagtagtttcatttcaagtcacggattctggataccaaccaagctggcaaatgaaaaataacacagccagggccatttcacccaccagtgatctctgtctgtgagataattcctccctgaggtttctttctctccactactgtgttcttaaaggcctaacacagggcagcggactggtgccactgtctaaggtttcaattaagacgtggagatatcaaagaagtaacaaacaggcctccacaacaatgcctcatggtttgctctcagttctggttaagagatggcaagatacttgaaaaatgtagttcattaatcctcacaacagaccccggaggttgagaggacagaaatggagccagcaacaggatcgagtttgaatagcttctctgttggttgtgtacattgggagctgactgtgaaatctatgtggacatactgaaccctatggttaacctcatggtgcaaatgtgttgatcaaaggcactctgtcagtatctgattaagagccatgtaagaacactgaagacatttccttctgcttaacaactctgattacagggggctcctggagtgagttttcctgtaagcagtcaagcaggtccctgggctccagctgtagctatagggtttcccaatggcagagcttcctgttgctgaaggcttcaattcattcacagcttgtaaatcagtagcctgtaaatcaacagattgagctactactgtttaaaacacagtttcctcaacaagcttccttctggttttgttttcatatatcaagggtatgaaaaaaaagtgtccaaattttaacacctggaccgatggggtctcagcaggagaggtatgttgcactaagctctgcagttttgtttttgtttcagcggagcaaggacttagtgactaaaatcaagacagcatttccttagagaaatgacaggggacaattttagaaaactgaaaatttcttatgctgcatgcaccgcagcaatttttaatgtccgataagaggtacaacaaaaagctaaaactggaatgagaatcaccacattaattgtttgactctccagtattaaacatgtatagataccattttgaaattgatctgaagtgtttaatcaaactattttgaacattttatatggcttaaaggctgttaaaactgaatcaacagcaaaaggactgattaattgcagaaaatcttctattattaatgattaattgtacagaaagctatacatcaagaaagctaactgaaaatgtgtcaaacatctaaattatggcttcatctattattactaagtatgtttgttagatggcaataacaggtaccatatagtctatacaatattataacaagcttttattcattatggtcatgtttatttgacagagcagaattatgtgaaaagtaatttgtaaatcatattatgttcaaagttaatattaagtgttgataatgagtagccaagaaaattaacaacttcattttatcctggctcctatatgaaatgcaacaaactcacatggaaacttaatttattttccttgtcagcaatctggaactatcaatatattgattctatttatatgattgtctctaggttctatgagaaccgtagggaagagaatttgggaactaatcctttgaataacattattattattatcctttaagcagacttggatttgagggctgatccaggttctgggaaatgagtctttataagccagaaatctccctctgagataggatagagatgatgtcttgctccattttggtaagaaaggctaagagcgacacaaatgttcacacactagtagctcccagcattgcccttgggggacttggttgaactttttagacagggaagtattatttcctaggaaaacactacatagtgaaggtcaaaatgggtaagttaggaggcaaatattacttggaggtacaaaggttttcttttagcacaaaggagctgaaactcaagagtcagaagagcttagtggcaacatttggaggcaagtggcaaatacactattcccaacctttggggaaaggaaagcacaagacataaaaaatatcccttcctagtgaacaaaagtgagaattacaattaacatccagaaattaccatcctaaagaaagggaagtggaataaaatttcaggaataagtttagatggtattggaactcacggcatccctcacgaaagctgaacactagctattatgtcttatggttgatattgcctgacaaacagctatatattcctattaattcagtttgaaaatgaaagcagtcatatatttttccacctatcagtttcccatgctaatctttatcaaattgtttccctctgtcctcaaaccctctctacatttctacccaacacattagccattcattttttttttttcggaactcccattcttccccaaagggaccacaaatacatacctaagaagtatagacttaggaaaagagagaagcattttgcagatgcctgcaggagagaggctagatttgatttagatagcttaaggacctagaactaggacaaataattagtaggtataggaaagcaaagttgtctcaggacaaagctatatttgagttattaaatttggaaatatctaatttacaattagttacttcctatcactggaagcatgttataaaagtgtagtggccaattactatcagtatgttgtagaataaagtcccttcctaaaatgaaagtcggcaatgcaattttaaaaattcacttttaataggtaaacattattagagtaacaaatcaaatcagtttcaaaacataatttgtggatacttacacacttgtagtcattgctgtcagttactgtcacattaaaacaattatccaaaaatcatgaaaatttcttgctgcaacatttagtattattgtaccctcataagtcctcaattaattgtaaataaatttgttagcagcagccttatttgtatttgatttgggctcagaatacttttcagacaatggaaaggttgttgatagcccacaagcatagaaaaagtaatcttaggaagcatgactaagtattcaaattaccaataccatgattccagatcttgataattttactgtgaatccacgtacctaagccttctagtttatgaattttactttttagtttcatgactgaagtaggtaacctgacaaaatttaaggacatttagaaatatgtactttgctggaaccagttgtgatgtatcttcacttgggaagaagtggcttttgccagctgggaagagctcaaggttctcctgcctctgtttcagagcccctggtgatttgaggactgattcatgttcagttccccggagaatatagttaaattgagaaaaaaacaatcatcataaatcatatatgatgtctcaagacgtaacatttttcacataactcagaggctactccagtcatgacacttgaatgacatacaataataaggcacagggacctccaattatcagatcaaggtggtctcagaaaatggtagtgtttttttttttaaattgcaatatgtggctaaaacattgtgattaaacactaggtcaagttagcagagaaaccatctcatcttaatccctatacaactcattaaattgagatttcagcaaaatgtaacagaattataggaagaatcacataaagtgactcagaaatgggaaatacttgcggcatcagatctctgctttaagggtttttaaaaatctcttatatacaactttattatagagataaaacattatagaggactgggtagtaccttcaaaagtaatagctcaaatttccatgcattttcttcagttgtttagatctcataaactaaatattttctttaattgtcaaagatttgtacatgttacaactatacacatatatacattacaaaaaatattcttaggtcttggtaaaattctaactattagatttaagtgaaacagttcctttaaaaagtcaaaacattcactctaaattaaaactaagagagaaagagtctattgatgaatattatttttatggccattacctagtaattcatggagaaaactgaactcaaaaatcagagattaaatctccaatgcctcccttttacctactcccacccaccgtttgtgggtcttccaaagctttccttaacctgatttccaaatttatctcccactgttcaggtatagtatcattttttgctaatatcacatttatttgtcactatttcctgcacataccttatactttcttacctcttacctatttccagcaatttgtaaaaccagaatgcttatgaaaaccatactcatattttaggatctctttaaaatatcttcttgtttacatagtttcataaatctactccgaaacatagtggatccctctttttctaaacttcttacgcttagtatacaattcttcccaaacttttcatttcatgacatgtgcagaaaaccagtagaactgtagagcacactgaggtaagctaggatgtctttttacaagattggagacaacctaaatagaggctccaaaggctgcagatgcagcaggcccattggtgatgaatacttcagcacagctataaacaggtatgcctgtcgaacagaaataaattctatatcaattatttgacaggttttcaggtgctgtcttatatcattacctgtatcattcctcattattagatttttcttgtcctatatcctgaacagatcacctactgtttgaaaacaggattaattccttataattgtatttatttatttaaaattgtggtaaaatatacataccataaaatttgttattttaaccattttaagggtatagttagtgacattaagtatattcacattgctgtgcaactatcaccactatctacctccagaatgtttttcatctttccaaactgaagctgtaaccattatgcagtaattctgcattcgcctcttcccttagtcaaccacacattctacattcagtttcaataaatctgactactctaagtaccttttataagtggaattatacattatttgtccttttgtgactggcttatttcacttagcataatgttttcaaagttcattgataattgttttagacatgatagtaatatgttgcacatcaccacctagaagattctcaatatatattatttgtttatttttcaatgctcttctctgagcaccttacatttaatagcaacaatttaagtatgagaggatttcatttctgactactttagaaattgtgaatcatttctaagtgctattgcacttgatatctttgattttctgttaaactcttgtaataagaatcaatgtagccatttgtttgaagggagttattactgtcttagctactaattgactttaatcaatggattatagtttatcacccaaaattgcattgtcttaaattgaccctaataattcaattattttaaattagattatagtgtcacagtcattgataagactatgtatcttgatagttcttgttcttcagagggtgtctaatagacttgttaaaattactgtttctaaaattcataattttcttgtaaatgattgttagttatttgtttatataagtaaatttagtacacagtacttctttgttattggttaaactaacaaccttatcctctgtgcaagattatatatataatctatgtcatactaataaaaactagccaataaataatttattaatattaaaataaaataatttttgaaaataatttagacttgtgaaatgaatactgaaagataatacaaaacttaaccatttttttctagtgcctaccttgtttccatgttttctgatttctgttgcttttcattacataattcaatggttttctaaaaaaattataaatgagttcacctacatagtcctgcaagcaatctagataaagtatattgctgcagaatgcttttttatattgaggtatttattcttttcttatagatttattttgaatatttcttggccaatgcacctgggcatcatgacatttaaagctgtgatctgatttcatacaggcattgactctaagagaataaagctaaaatgattaatttacattgtacataaatatgtaaaatagtgataagacatttgactaaaacaggtttataatagcaagcaacagcaatagtgactaagataatgcagatattttgctacttcacatgctaactcccaaggtatactaagaattgagtaaatttttctgcataaatttcctactaattttagttctacaattgtcgatgacggttttgcagaataaaataaaattttatgaacagttacagaaagatattctgctaccaggatttttttttttttccagatggagtttcactcttgttgcccaagctggagtgcaatggcacaatcttggctcactgcaacctctgcttctcaggttcaagtgattctcccacctcagcctccctagtagctgggattacaggcacacaccacatcgcctggctaagtttttgtatttttagtagaaatagggtttcaccatattagccaggctggtcttgaactcctgacctcaggtgatatgcccaccttggccttccaaagtgctgggattatctggtaccagttttaaaataaaaaagaaaatataaatttgatatttctaatccattacatcgaatgtaagacttcagatttatctacaggaaaacttccctattaatagttaatttagatgagagcatttccttattgctaaacttcagggatttttgttgcatgagtcataatataaaaaaaaatctacagataatgcacacattataaatatattcctcaaataaacaacatcataaagtatgattaacttgtaactcatcatattctactcatattcttaaccattcaataaataaacgatatggtttatgtaaaatggaaatccgtatttttttacacccattttcctggtccagaccttattcactttataatccaggacttgattaaaaaacagaagccactgtatgcaaaatataaatggtttaatataaatttagatgattgtttttaagaactggcggactattagcgagaagtctattaaaaatcagataagctaccgccaaacattaaataagcatacactggaaagctcactttaaagcatcaaggtgatcatatgttgttctcaaagatttactagaaagctcctgtaattcccaggaatttctatgaagttttcacctcttatcttagttattagcaacaaagagtgcttagtgaaaagtgggaaaccactgagaatctcaaatctccatgcgtatgactacatttgatttctccttcttttctgtctttcatatcttggactgggtccccttcattagcaaattaaccttgaataaaacaagaaagacacttctagctaatacagttcctaacatgcagagcagactgggaaaaagatagtgataatgtcaagttgaaaactgataacctgacaatttatttttgctgtacattgctttttcatttttcagttttgaataagctttaggttaacgtgctataactacccacataactgaagacttttcattctttccttgaaagaggagatacaaagtctgatatgccattcacacatctcagtgtgaagttcatttatcttctaatcagttacaaactatgtatccatatatacatatgtggatatagatgtatttataattgaaacattgaaatattggactaagtaatattaatgcatttatattcaatataaggaaaaaggtaaaatggaaaaattaatgtatgcaaatatataaatattaaataaaaataattaaatctataataacagcacattcatgaaactggatacatggccatggatggtatttgcaacttctttcttccactaaccattttatgatcatcttgattttagccaccatcttagcatgccagggagttttacctttcgtggtggctgtgcctttatgcatgaaagactcgtgttattagtggtcctgcctgggttgggtttctgtactttgcattagcttttacttttcaacatgaaaaccaccacattagtcccattatgtatttatagctctctattttgagttatccttgccaagacagtaagcccttcctttacctctggattcaacagcataaaaaactaatgtgactgaaagacaggtgaacaactcagcttccttttcaattgagcctttgttgtttccattggtgaaaacattctgatgtcaagcagagtctgaggtggctggtaaagaggacaggctggcatacgtagtatagattatcttatctacttgattattgagagcctcctatgcatcctgttggtgagtatgcaattaatttgtgcctttacaaaaggtccattctaatatttctactccagaacatgtcactagtgttgttgttttttcctctaaaattcagccaaatcattagtcactgcccatgaaattatgtagatatgtgtctctggccatttctttcagacagtgaacactcaaaattaatgtttaaagttctgctgactgggaggattacttatactattacctcctagggccactgccgaatgaataaggcaacagtttagtaaatacacacgcatcagtcacagtgatgactatcaataagtaaccacaaatgcttctttgggtaaaatcattctcactactattccaatcatgctatagtaacaaagcttatcttgtttctgaaggtgaagtattgtcattgttctttgcttctcaaagactctattattccccactggattcaggaagctgttttcaatggtggcatcttacactgtaatttgtggcctaaacataattgtttttaataacgtaggtactctttttatctctgtaaagagaagct

SEQ ID NO: 1930 - DNA, 18012 bp, Homo sapiens
gtgccatcctcttctttctacttaaagatgcactttttaaaacggcaatgtatttgtccttctcttcttccaaatctcaaaaatactcagtgaattctaataaataatagattaagttttctgtgattattttagccagttcattagggaattggggtcttgcagaagtatataaattttttaattgtttaacttgactcacatttttattagaatttgtttatattttaatcaaggcttttcattctgctgcattttgtggggcataattatgttttcataaggacatatatgatacaacatatgaattaataactaaacaggagacttagacttacttccaaatcctttttgaggataaaaaaataatgggaaagagcatcacttctagctgtagaacagcaagcaaaaaaactagaaagtttgcagattcacaacttttcatggagtcatcagagaactaaggtcgtagggcaaccagctaacctgaaacttaggaggagacatgagcacttgttttcctggagcagatactgccagatagcagtaagaatttagctgaatttttaagtcgaattggtaaagccagttgtgcactagaaagataatatagcaaccctattgactgcagatatgaggggaatttgcactgcagtcttttctccatagacttcaatgtatactcaatatctataatatttatagatattatacaatttattttgtaaatcaaaaaaaaaaaaaaaagatcgtctacagccctctgaaagcatctcttctgatacaggcatagcataagaagtacaggaatcactccgagaaaggcaggaatcatcacctggatccttctccccttccccctacagaagaaaagccttaaactgctaagtgtaggacagctattgtctgaaaaacagtgtaaaaggaagacctaaagttgagagtggagcagatactgagaaaagaaatggctatccatgtattacccatcctcaacacaagagaatactagaggaatttgaagcctgtgatgccaggtaactttggtaacaacaaatcccaaacctagcttaactcctgagtagaatgattcaaaccgcagatctagcagaaggacagtcattctcatttaaagacataaacactatttactcattctttaatgtcctacgcaagatatttagttttaaacaaaatgtacaagacgtgtacaatggcaagaaaaaaatgggcacactgccaaaataaaaagaattttataaaagcaaagatatgacttacataataaaactgtgagacagaaaagttttaattactgtcattaatattttaaagactcaaatggaaaaagtgaacaatatacacatcacataggtaattttagcaggcagctggaaagcataagaaagagtcagatggaaatactagaactgaaaaacatagcaacaaaagtgaagaatgcatttgataggctcatcaatatggttggtacacctgaggacagaattattatacttgaaaacgggtaaattgagagctgaggtagaatagtgtatttgcaatcttctgggaagtagtcttaaatatgtgtacttgtaatcccagatggagaaacagagaacaggaccaaagaaatatttaaggaaataatggcaaataattctctgaaattaatgacaaagaaattaaggaggatttaatgagaaaaaaatcaatgagagacaccaaaacaaattgaagaagctcagagaacgatacacacataaacacatgtataaaaaggaacccatattcaaattgctaaacaccgaagttaaaaagaaaatttggaagacatcccaagaaaaagacatattatgtacagtggacttgttatcagaaacaaggcaagtcagaagacaaaagggtgacatcttgaaagtgatgaaagaaaacaactctcaactccgaattttataaccactgaaagttatcatgatgaaggagaaatgaagatgttgtttgacatataaaaatggggagaatttattgtcagcagagcttctatataagaaatattaaaggaggttctttagggatatggaatgtaataccagagttaaacttggttattgatatggtttggttctgtgtccccaccgaaatctcacatcaaattgtaattgccacatgtcaggggagggacctggttggcagttattggatcatgggtgcagatttcccccttgctgttctcatgatggtgagtgagttctcatgacatctggcttttaaaatttgtagcactcccaccttcacttgccctctctcctgctcttctgtggaaagatgtaccttgtttccccttcaccttctgccatgattataagtttcctgaggcctcctagtcatgcttcctgtcaagcctgtggaactgtgtgtcaattaaccctcttttcttcataaattacccagtctcagttagttctttacagcagtgtgaaaacagactagtatagctatacagaaagaagtgaagggcgctgaaaataaaatgaatgaaggtaaaaataaaacatgtttctcatatttttagttgctctagaagataactgaccacttattaaaaagtaatagcaatgcgatatttatttatcttacatgtaaaaataaaatatgtgacaaaatactacagatgttgtgtaggagaagtattgggatatagtgttacaacattcttataatacatattaaacaatataacatttgggagttgactaaagatatgtaacttaaactagggtaagtattagacacattttgaaaaattatgtattgtaagtgaataccagaggtaatatggtatcataaaatatatttaatcaaaaaaagagaagaagaggaaaaaaataaacaacatatggaacaagtagagaacagacagaaagatggtagatttttaatttaacagtgttaataattacattaaatgaaaatagtctaaacacattaatttaaaaactgaatgacagattgggtaacaagagcaagatccaaatatatactgtgtacaagaaacccacttaatgtgtatggatatatatagaaaagtaaaagaatagagaaagacagattatggaagcatcaaccaaaaaaactagaattgctatattaatatcattagactttaaataacatatattaacaaggttaaacatgaacattaaataatgacaaagaaatcaattttccaagaagacaccttcagtcccaaaaaactatttaaatatatatgtacttaacaacataaattcaaaatatataaggtgaaaatgaatagacttgaaaggataaatagataaatccataattatattggaaggctgtaacagtcctttctcactaattaataaaacaaccaaataggaaatgagtaagtataaagaagacctgagcaacacaataagcacgatcagccaatttgatctaatttatatttatataacagtctaagcaacaatgcagctaaagcaactcttcaaggaaaactttatagatttgatgcttatataatatcagaacagaaaaaaactaaaattcatgatctaatctaccatcctaagatactataaaagtaagtgcaaattaaatccaggacaagcagaaggaaaaactaataaatatagaagcagcaatcaaataaattggaaacagactaatcaagagaatgaatgaaattaaaagctggtatttgaaaaaaggcattaaaatataataaacctatttttgaaagatatacaacacgaactttcactaaaaatataggttatgtgagtagtcctgtttgtatttaaaaatcacttaatgaagaagcctgtaggctcagatagattaactagtgaagtctattaaccttttaagaaaaaaataatataaattctacccagtcacttcccgaaaggagaagtagcactttcgatttatctaatactgaaaccagccacagacatcaccaagaaaagaaattgccaaccaacacaccaatacctctcatgaatatagatacaagaatcttcaataaaattttaagaaaaatcatctagtagcatattaaaaggatattatattatgagaaaattgtatttatccagaaaatccaaaattgatttaacattagaaaatcaatgtaattaatcatattaataaagaagaaaattcatatgatgatctcataaatgcagaaaaagcatttgacaaaattcaacatctattcctgttaaacttctcaaaatactaaaaaataggaagataattcgttaaccttaaataagacacttattatagaaataactggcatcatatttattagtggaaagctcagtgcttttccactaagatcagaaacaaggtatatgaacctacatttcctttttttttttttttttttttacattgtccttgtggcatgcaaccttactaaaatcacgtatttgttttaggatttgttttatagattgttggggattttctacatagaaaccattactgtatgtaaatagatattgggtgcgaaagatacagtcacagaacaaacctataccattattattaattaattttcttaaaaaggtgcagaaaattcaatagagaaatgtattttcaatgaattgtgcagaaagcaattagagatctatatctaaaaaatgaacatagacccatgattcacaccttatataaaggttaaatcaaaatgtattataagtctgaatgtaaagcaacatgtaaaacttttgaagaaatacaatatttgtaacttggagttcaacaaattcttagatatgataccaaagtcatcatccataaaagaaaatataaatatatttaactttaagaatataaatttttgctcttgagaagacattattaagacaatgggaagcaaaccacagactgggagaacatattttcaagtcaattaattgacaaaggatttatattcagaatatataaagaactcatacaactcaataataattaaaaactatctaattaaaacaaatgaataaaaaattaacaggtacttcaccaaaaaaagacatatgaatggcaaataagcacatgaaaatatgctcaacctcattatctgttaggaaatggaaatttaaaacaaaatgagataccactacacacctattattataactttataaaaactgaaaggggccgagcgtggtggcttacgcctgtaatcccagcactttgggatgctgaggcggttggatcatgaggtcaggagttggagaccagcctggccaatatagtgaaaccccatctctactaaaaatacaaaaaattagccaggcatggtggcaggtgcctgtaatcccagctactcgggaggctgaggcaagagaatctcttgaacccggggggtggaggttgcagtgagctgagattgtgccattgcactccagctctggcgacagagcaggactccatctcaaaaaaacaagcaaacaaacaaacaaaaaaaaccctgagtgctggggagaacctggagtgactggagccctcagacattgctggagagaatgcaaatggctgtcatgacactttgggaaacggtttggtagtttcttataaagttaaacttactttatgactcagccatcacactacaaggtatatactcaagagaaatgaaaacttaggttcacacaaaatcttatacgtaaatattatagcagctttatttataatcaccaaaaattggaagcaattaacatgcattcaaccagtgaatgcataaacaaatggtggtataaccttaaaatggacactcagccctaaaaactaaatgaactattgatatacacacacagggtaacaaactacatttttccatttatatgacatattggaaaatatcatgtaaataaaatgttttgaacaaaattagagtcagtaggtgcagttttggtttcacttggctttctatttattattatttgtataaatttaaggcatacaagagcaattttgttacatggatatattgcataatggtaaagtctgagcttttagtataaccatcacttgaatagtgtacgtcgtactcattaaataatttctcatccttcactaccctgtcacactcccatcctttcaagcttttccactgtccattatccacactctgtgtccatttattaatgtacacattgtttagttccgacttataagtgagaaaatgtggtatttggctttctgtttctgagttatttcacttaagataatggcttctagttcatctgtgttgatacaaaagatatgatttcagtctttttatggctgaatagtagtccattgaaaaaatgctcaacaccgctaatcacagataactgcaagttaaaaccgtcgtgaggtatcatcttacaccagtcaaaatggctattattaaaaagtcaaaaaataacagaagttagcaaagataaggaggaaatggaatacttatacacgtttagtgggaatgtaaattagtacaatgtctatggaaaaaaatatgatgctgtctcagagaactaaaaatagaactaccatttgatcaagaaacccactactgggtatattcacttgtatatttatcacagcactattcacaatagtaaagatatggagtcaactaagtgtttatcaatgaatgattggataaagtaaatgtgaagtatatatacacacacacatagacacacttggatttcttattgctcatctcgtctcttatggtatgtgcgtttgtatgtttgtgtgatgcttttattagtaagcattttacattaaaatattatttgccatataaatgaatgcgaataacctgtagcttaattatttttatgtggtataagtatttattagaaatcaaatggacgttgaaatttagtatcatatagaactttaaattaaccccggaagtaagttatatttcctccacactcgttaatgtcactgcaagttgtttctccatcacagaatataaatgggagtatatagcaaatgtctagcatgctatgtacaataaataatgtatgattaattagtcattttttaagtggaaaattattttaaagtagtttgaactatgatttaatttttaaatacacttaaacagtatgttagattagcaaaggcagaaatattttcatcactttgttatttattgatgcctagaccaatgtttggaacatagtagacctctgattaatatttgttgaattatttattgaatacatttggaataataatacatcataactaaatataacaaaaccatttttctaaggtatactttaggaaaatctagaataaatatgaattttggggttgtagcattgttatattatgaatatggattgaacactcattaataggagagagaggaataaagaataaataatctttgagatgaagatatttccatgtctaatattgtaggtaacaaaaatgatagacttatatcttttagaaagagttacctggctttctattatgtactgcttttctgatgatttcattgctttagtatttttaacttgtttctaataagagctgattggttatttctccccttagtatatataaatgtagctattctaaataatcatttattaacacaaattaaatttttatttcatttattgatacagtttgccagcgattagtgtccgagttaagaaatactgttatagcaacagcaatttccctagaggacttcttaaatcataaagtgagagtatttcaaattatatttgcttcacttaaatgtatctgttctgaaaatggcaacattgatcccatgatatacctgatatattctaattgcctagaacgtaaaccacaaattctgcattgcagatactatcacagtaaatgctgcttaacttatgcaaaatttatagaatgatgacaaaacaaaagcttctgagaggataagtgtttcaccacaagcggtttctgtatctgactccatttctaaactgtaaatcagccttaaattatcattgagtcctatgatagacactagtaatggtaagaaaatatgccattttaagctatattcttattgacctgtatgtttatatgagtgtgaatatgtgtgtacctgtgtgtacatgtttatgtatgcacaccttttttacacgttattttttaactaaaatattttttctttactttactttactttacaccatcatgcattgttactttgacctctacaacctaacaaatatctgccctctaatccaatgggaaggaacaaaatcctgtaagagtgtaggaaacctgaggatggtctacaaggttggctgcccattggaaacacttgtggaattttaaagagatatcgatatctttgttccacccaaggaattctgattaaaaatttattgtatgtacattggatatctgtatttaaaaaaaatctccccaagtgatcctaatatgcagtaaaatctgaaaatccttcctctagaaaacaaaaataaaagtgcctaataaacaatgattactgtgtattctgaaaccagaaacaaccattttcttaaccttttatggtttaaaaaagtatggtaggaaagttattttaaaaggaattaaaggtgattttatgtgacatatgtttatttttttaatgcaatcttcattataatggttttgaattaaggtataacctgtttttcttgtggagtgtatgcaatagaaaatcacccaacttaagagtcagaaaacatgagtgtgtgtggtggttctgccacttcttaaatatattgccttggctgggttctcctataagacttactttcttattgcccatggtagtacaattgttatagcatttcaaaaattaaatggtgtgtttataataaaggctatatataacaaacccaaagctaacatgggtttcccatactgaacaggcaaaagttgaaagcattccctctaaacactggaactagacaaggatgcctcctttcaccattcttactcaacatagcactggaagtcctagccagagcacttaggcaacagaaagaaataaaggtatccaaactgggaaagaggaagtcaaattgtacctttttgcacatgacatgatattagatacagaaaaacataaagactcaaccaagaaactcttggaactgataaatgaattcagtaaagttgtaggatacaaaatcaacatataaaaatcattatcattcatatatatcaacaatgaattagctggaaaagaagtcaagaaagtaatcttttttataaaagccacagcaaaaaattacatacctaagattacattttaccaaggaggtgaaagatctctacaattaaaagtataaaacactggtgaaagaggacataaaaatattgtaagatgactaggcacagtggctcatgcctgtaacctcagcactttgggaagctgatgcaggaagactgcttgagcctgggagttcaagacccacaacatagcaagggacaactctacaaattttttttaaaattagtcaggcctggtgtcatgcacctgtagtctcagccactgaggtggcaggattgcttgaacccgggaggttgatactgcagtgagccatatttgtgccacctcactacagcctgataataagaaaagaaagaaaaaatagtaagacaacccacgctcatggattgaaagaattaatattgttacaatgaccatactacccaaagcaatctcaggttcagtgcaatccctattaaaatttcaatgacatttttcacagaattagaaaaaatattaacatttgaattgaaccacaaaacactttgaatggccaatgccaagcaaaaataacaaagtcagagatatcacattacctgaattcaaaatatatgacaaagggataagtaaccaagcagcatgatattggtataaaaacagacacatagaccaatagaacagaatagaaaactcagatataaattcatgcatttatagccaactgaattacaagaaaggtgccaagaatgtgcgctggggaatgggtacccttttcaataaaagctaggaaaactggatatatgcatgcaagacaacgtaagtagactcctgccacttgtcaaatacaaatatcaactcaaaatgtattaaatatttaaatgtaaggcctgaaaatataaaatcactagaagaaaacataggagtaatgcttcaagacatgagtccaggcaaagattttatgggtaggactatgaaagcataggcatcaaaacaaaaatcagcaaaagggacattataagctaaaaaccttctgtacagcaaaggaaaaaaccgagtcaagacacaacctgcagaataggagaaaatatttgcaaattattagtccaagaagggattaatatccagaatatataaggaactcaaacaactcaatatttcccaaacaaatgattctattaaaaatggacaaaaaaatctgagtagacatttctcaatagaagacatacagatggccaataggcatatgaataaatgttcagcatcactcatcatcaaggaaatgcaaatcaaaaccacaatgaggtatcacctaacctcagttagaatagctattctcaaaaagacaaataataacaaaggctgctgaggatgcagagaaaaatgaagttttatactccattggtgggaacatcaattagtacagccattatggaaaacagtatggaagttcctcaaaaaaactaaaaatagaactaccatatgatccagtaatcccactaatggatatttatccaaatgaaaataaatcagtagatcaaagagttatctttacctccatgcttattgcagcactattcacaatagtcaagatatagaatcaacgtaagtactcctcaacagataaatggatcaagaaaaatgtggtatgtatacacaatggaatattattcagccattaaaagaaggaaatcaggtcgtctgcagctacatgagtgaacctggaagaccttatgttaaattaaatgaatcaggcacaaaaagataagtactgcatgttctcactcaagtggaagctaaaaaaacaaaaatgagtttatagaaatagagagtagaattacagttgttagaagctgggatgggtagcagggaggagaggagagggagaagttacctaatggatgcagaattacaactagatgggaggaaaaagttctagtgttctgtagcactgtagggtgaatatacctaacaataatttattgtatatgttaaaaatactagaagagaggattttaaatgcctcctacaaaaagaaatgagaaatatttgaggtgatggatatgctaattaccctaatttggtcattacacattgtatacatgtatagggatattgtatgctccatatatatgtacaattattatgtgtcaactaaaaacaaaagaaaaaagtgtctataattattcaggtataattttacactgttatctgtagcttactctggcctcttatgttgacaaactgtgttttttaagttcactttactgaatgacatatttactgttaactcatttcatgtagtttttattaaataattattcaatgcctactacatatctgtcagacacttgataagtgttgaatgcacagtgtcacgtgagacatggttcctgtctccagtgagttattgtccaatgcagaagaaagatacacacacacatgcacatgtgtattttggaggatagggtgaactaaaagtccaggattgcataagtaaaatgtgaaaatgctcaaatcaagaaggtcattgtgagttctttaaagcccaaaccaaatgtgttcaaatctaagtcatctttctgatgtatcttaggcattgaagttttggtgcactgagtagaatacatcgtgattatgaaatgttttcattgggacgtagtataaattaattgataatggtaaagactttgaaatcatattgtcttggttcaattttttcccctcaacacatcagctgtatgattatggataggtttttaacctttgggtttcactgtcctcatatgtaaagtaagcaaatagtgctaatacttcttggacttgttatgagaatgaataggtaatacctacaaaatgttttgagtgttgtccttacacatagggattagacaatatccactattattttaaagttactttaatgatattgcttatttgggaagcagattttttttgccttttctatatcagaatggttagttgaaaatattttacttttaaaataattattgaactgggaaaatgatttcatcagcaagatacagaaaaaagttggcaaaggtaaaaatacttttatttttcatcaaaatattaatatattatttttctgatttatggctcagacctattcattattattccttagatgctcgaatcctccatacaatgtggtacttttaaagagaacatctgtttttgtacaaagtgttgctatgaaacttcagtaggaaaacatagcaaacacatatacaaagtttagtactgcagctaaggcatgggattatattggtttggtttgttcattaaaaaaaggaaacaattattagctaaaccacacatttcagatgaataaggataagaaattcagggattatattgttctttggtaaaaaatctttgttttatagatttcagtgccttgaaggctcataggaaatgtagcttcttttatgtctaaatgtgttttgttatagaaattactcaagctatcttaaatgaagacctcaattgaagtttttagactatattattttgcttgtattccacaataactgtgttattacttccaatctttgattctgagaaatctggcctttattttttagagagagaaaatctcttgagagttttgagattagtgtagaaatatgcaattttttattccttctaaatttcacgcttttatattagaagatgttctgtgaggtttttttctggacagatattaagacagaatcaatcaaaaccaacgtaaacacactgttaaattcacacacaagaaaagaggtgtgtcatcaattaatttacataaattatctagctggctttgaaacctattgacatgtgagaagttcagagttccttcagcatagggcattctgttaagaatatacatgtttaaacagacaaaagaatttatatagataccatagacattttctgtaatgatatgaagtataatttgtatttactttcttcaaatatgggaatctctaatgtctttcaaaattaccatgatgttgaagacaatgtttatagtgatctcatatacaagtatagattttactgctctagtgatatcatttacaagtatagattttactgctctttcttctttgtttctgtgcaatctgttacaccaaccaaaaataagattgaaccgagatatgatttttagtaaacttggtgcttagtaaatttatttagatacttagtaaattaactaaaattaatttaggtgtttagtatatttattgaatgaaatctagcctaatatttataactggaatgttttataattgatttataaaaatcacaagtgatgttctttttatacagtatctatgtctttatcaagtcatagagattatatacttagtataaagagcaacatcaagattttgatggctggaaagaacactagaggaggacccctgaatatccattttcacttaacttatctgagtctgttaccttgagcataaaacggaaacgatgacattaccccagtaattatagttttgtgtttttccccagtcaccttagaaatatgtgctaagtacctcattatgtgctgctcataattttaaatactgtactgaggatttgctccctactttcaaagaaataccttatagtcagtgggggaaaaaaaactagcagacttttactacaaggtaatatgttatgacattataatttggttttatttgttggtcgcagcttaaatatcacctcttcagaggaatttcctgatcacccagtctaaagcagccttccagacaatatcataatcttttttaaagtgcacagcactatctaaattttctttcttatttgttcattatttttctgtctcccctcaaataaaatgtcagtcttatggctgcagatactatgttattcttttcacttctttaccctagtccttatcattatgcatatatatatatatatatatatatatattaggttttcattaatatttattgaataaatgaatgaaaggaaacttaaaaatacttgtgccatggcagcatagataaagagactttattaatttaaataattttttttctactatgttccagagacatactgtttgccccggggaatactttgttaatcttagtctggcgggaaggcattgatcagctttataattgcaaacaattgtaagtgctatggagaaatagtgaagggtggcatatgactatgttgaagaataaggtatttccctaatatgggagattagaagccttttgaggaagtttcacttgagctgaaatttgaactgtttgaactaaccaagtaaaagcaatgagaacatcatatgcaaaggccctgtgatgatgacagcagtagtctttgaagaaagtgaaagaaaaccagtatggattaactgtaatgggtgagcacttggtagagtgggagagatataactgaaatgctggacacagaacttgtaagtcactgtgctggtccatattagtagttgatatcggaaagcaaaatgtatacaggagaaacagtgtaaataaagcaaaagagtaaaaaaaagttagggatgcatacagtgtttgtcctttgacataactgggttactctgaaatatcaacattttcaaaatctcttctgtcaacactactataaggacttttatatatatatatatatatatatatatatatatatatatatacacacatgtatacataaaaacatgtattgcaaatagaaataaggtctctatttaaaaatctaacagttatttgctaatcacttatttttatacatataggcattagagaaaaaataaatattcatcaaagtgaattaaaaacaagtttacagtataatcagtagagaataggtcacattaaatacaaaatgtataattaagtcaaaatattcattgaatgtctgacttgcataggaagagacacaaggtctagtactattttcaaaaaatcagctgagacataaaacatacatgtgacaagcatcataacaaacatgtgacctacacaaatataaaaggaaatagctgagtaagagctaggcttggccaggtgcagtggcttatgcctataaccccagcacattaagaggcccaggttggtagacgggggcaaaacccagtctctacaaaaaattcaaaaattagctgggtgtggtggtggtggcatgtgcctgtagtcccagctactcacaaggctgaggcagaatatcacttgaacccagaaggcagaggttgcagtgagcagagatggcaccactgcactccagcctgggtgacagagttagactctgtctcaaaaaaataaaaaataaaaaataaaaaaatataagatttgggcttagtaaatatagaaggctttgtaggggatcaagtttgaattgcattttgagaaaagaagatgatgaatattaataaacacgtgaagtgaatgggagagaggctagtaatcaaaggcatgaagcccaagccatagaagtaagaactaatgaaatgtgtgaaattaacagatattaattttatggaaagataaagctcaagagtagaaaccttgattaaaaagatacctcgtcaattatctgaaggataagggaagaaagagcatttcagatggaggcactccctgtgtgaaagcttggatcattcagtgtcagtcatgtagcaagatgatgttagcttggagatgtagctatggtagaggctgaccactactaaaggagctaggtcattataggcctggtcatcttgctatagagctgtagtctggtgcattgaaaaagtactgagtgaaacagaagggagctaggacatgattacagagggctgggagggagatgatgaatataaaggaaaagggaagtgaggagagaaactagatgttagaggtatttagtcaattcagtaggatttaatgatttattgcagacagaatgaaggggaaggagaatgaaggataattcttatgtctgtttagctaattgaacacttaaggggaaccctgggccaacaaggtttttctttttttaatttttatttttttagaagagatagtgaattaaatgttatttgcatttaatcctaggtaattgagatacacaggatgagatatctagagggtagatagtcaggtccagccttggtgttacccatttggaagccatagcatcgtaatggattagattttagctgggcctaggaggatgaggtgtgttattggtcagtaccagggaaaaacagagggcttctgagctgcatggtgacatgtccatggagtaaggagaagacaggtatcactgaactcagcatgtgctggaataatatgtgataaggatgaatcatggatcagtaaggtgaggcaaatttatagatggaagtaacagaataagaggtgctacactttttaattgaagcaacttttagaaaaggaagatgaaattacacaatgaatgaactgcttaaggatgaataattgggtagacattggaagacaggactttatttcagtcaagtcatgtgaattgtggttactgtggttggaagatataggagaggtacataatagctgtcatataagagacaaagaataagagtaacatggaaatgtatgctcaaatgagacagatcaataattgtattcatgatttactgacacgaaatgctctttattgcctgtatcccaggtcttaccttgtttccagttagctgtgatttcaaagaagatactcctttgtgacccttgcttcagtcatctttccatttctttcttttctctttgtttctgctaacctgctgaggaggctgacagctctggacgcaagtgtttttgcttcaggagtagatgggagaaaagcatgtcctgtagttataatgctgctttttcctaggcagggagaagcagcccctaaattctagagaaaaatactgccttagttcaatgtagcagttctgatattcctgtgagtttaagaaaaaacaaacaaacccttcctccgctcaccaaacgaagcaataacaaaccaacaaaccagaaaccttaaagcagaggaaatccagattgtacttactcttcttctcactcacaaagaaaaggattcaccacatttttactgtcatggcattattgccgttaaagtctttttctttctctgtctagtaagtcttttttttcctgttcaatacagtttttttttgcttgttcattttttttccgatctagtggagagaacattgcaggattatgaataagaccctgagctggatgtcgtggctcatgcctgtaattccagtgttttgggaggatgaggcaggaggatcacttgagaccaggagttggagaccagcctgggcaaaatagtgagaccccatctctaccaaaaataaaaaaataaaaataaaaaaagaagaagatgggcatggtcatacatgcctgtagtcctagctacttgggaggctgaagcaggaggattgctgtagccaaagagtttgaggtttcagggagccctgatcatgccaccgagtacagtctagatgacagagcaagactttaaaaaattaaaattgaaaaaaggaccctgataaccatttgtagatacaaacacatttcaagttgggtctggtgggccgttttcctttagggttcaccacttgtggtgccatgttgcaaagacacagtgctatttatcatgtagctatctta

SEQ ID NO: 1931 - DNA, 3947 bp, Homo sapiens
ttattggagaacagtaaacagtttgatgttgatgaagattaaggtaggtatgggaaacgcagtggagctggtggcagggtagttggggacacaggatttgcagctgcaaagacaggaaacttagaggtctgtgaaggttcacgtgtgccatgtaagagcctgagtctgcatcaggaagcacttgaggaggccctgaaggacttgcaacaacaaagaatgactttgcgctttggctgtgattcagtcaaagctttaatggcaagaccatggaatatcttttggaaatggtgtcataaagcttgattttattatgttgaaggatctctgagtaaagctgaatttgtcatttggaaatatgaattaactttatcatattcttcttgcatcttgttgatgtttgccgttgtgagcttcaagaactgaattgaaaaaaaaatgcaatagaccagagctctggccgggcaaggtggctcacgcctgtaatcccagcactttgggaggccgagacaggcggatcacgaggtcaggagattgagaccatcctggctaacacggtgaaaccccgtctctactaaaaatacaaaaaattagccgggcatggtggcgggcacctgtagtcccagctactctggaggctgaggcaggagaatggcgtgaaccctggaggcggagtttgcagtgagctgagatggcgccactgcagtccagcctgggcgacaaagcgagactccgtctcaaaaaaaaaaaaaaaaaaaaaaaaaaaaaaaaaaaaaagccagagctctattttatgagatcactctgtcacttgtatacaataaattttgtataagaccatatcgatctatgtatctatcacaaggaatagtgtaggttctaaacactttgatcaataaaacaagtagttttatatatgcatataaaaaggaagaaataaaacatattaatcaagcatagactataaaaacttctccacagggttcatttttctttgaaacaaactactagatgttttaggaaatctaatttcatgtgaagttttgctgcattttagttccatgaggaaaatttttcattcatactttttcagtgtcatttgataacaatacaaactagttcatatattcttttagagaatgtacttcacaatttgatttggttgcaatgttcataatatgctaccaaaaaattagtatcccttttaataaataagttgaagttaaaggaaatacccagtattgctgcacctgcctcaatcccatttctttacatgaaccggcctcatctgtgcactaataataaagctgaaccatggacatgccactgcagttggcctcccatagctctgcactacctgtttctgttctgggacagtttataagattatgccaagactggtttcccccaaacttgtctttgagtctcaggtagataaaacaggtatttacttttcagaaaagtaaagtccatagctatttattgaatgcttgctaatattgttaggcacagttctaggtgctgttcatgcattgtcacatgtaaggctcacagccaatgaggtaggtacttttattactcccagattacaaaggagaaatttgaggctcagacaggtgaaataacttctcaaagtcacccacagaagaagcagttgtatacaatgagcttgaattgaatgcaagttagtcaggctccatagctcataacttgccaacaccacattcttcttatactgtggtcaatactatgagaaatgtttcccacactacataagtttcttcaatgtacctcctagggttagtactttcaatgtgcctcccacttagggtacctagtcagtgtcctcactgtctttcagctctgtctactgaaatttagcctctccttggtttctgtggaatttggcaagtccagtgcagtgtctaactgggaccatctccttttggcagcatcaagttaggcttactgttagtatcctccaaacttgttgctctggtttgctggcagctggagtctagctttgacagttactcagaaatggagcattggccttttttctctagtgactcggtagttctttgaagaaagtcatgggaagaatatgagctttacactacaatgacctgaatgcaaacatcaactcagccatttattgttgtgcagcttttgtcaagtgatttgacctctttgagcctcagtttatcatctatataatggatattaaaatatatacatcattaggctttttgtcaatttaaattaaataatagaatctctctatattcatggaacccctgtatagttagcactcaatgaacctgccttgttacaactttaaaaaaattatattcacttaaaaaaatggggtataactgaggtttacatatgaagttatgggatacatatagatagtaaaatggttattacagtgaagcagactaacatatccatcacctcacatagttacgtgtgtgtggtgtgacaggagcagctaaaatctaggtatttaagaaagatccctaatacaatacaaatttattaatagtcctcatgttgtatattacatctctagacttgttcatcctacacatctgctactttgtattcgttggtatctccccattttctctcctccaccctgggccctgttagccctagattttttctgcaagtttgacctttttattttaatttcacatgtaattgagatcatgcaacattttttctttcagtgtctggcttatttcacttagcataatgccctctgggtccatccatgttgtggcggatggcaagatatcctttattcttgctgaataatattccattgtgtaggatgggtatatatatgccacatttcctttatccagttgactttggtcgtttccatatcttggctattgtgaacaatgctgcagtgaacatgggaatgaagatatctttacaaggtggtgatttcatctccttcagatatatatcaagaagatggattgctgggtcatatggtaatctatttttaacatatttaggaaccatcatactgacttccataatagctacaccaatcaacattttcaccaacagtgtataagggttttcttctctctacccccaccaccgtttgctatcacttgtctcattgataagagccatattaatgggtgtgaggtgatatttttatagtggttttcatttgcatatccctgatgattaaacatacattttcatatacctgttggcatttttatatcttctttggagaaatttctgttcaggtcttttgcacattttttaattgggttgtttttctgctattgagttgtgagggttttaaattttgaatatcaatcccttatcagatatgtgggttacaaatatttttcccactccacaggttgccttttaattttgttttttcctttgccagacagatagatgccttttagtttgatgtagtcctttttttttttttttttttttttttttttttttttttttgctgttgtagctgagcttttggtgtgatatctaaaaaatcttggccatggccatgtcagtttttcctctacgttcccttctaagacttttatggtttcagatcttacatttaagtcctttgttcattttgagttattctttctggatggtgtgaaatggtggttcaatctcactttttttttttttgaatgtggaaactcacttctgcaagcaccgtttatcgaagagaccacccttttccccattgtgttctcttggtgcccttgttgaaaattagctgatcataaatgtttggatttatttctaggttctcttctattccaccggtcgatgtttctgtttatctgccagacatcatacttcgtgattttaaattataatttgtaaccttagtttctcacagcagttctctctactgcttcttcatgtcagggttcttctactcgaat

SEQ ID NO: 1932 - DNA, 1886 bp, Homo sapiens
tgacatacataacaaactttataatcaactgcatagttttgactgttaaaggtaaaaaggagctttatctcaattttttattatttcatatattttaattacaatagctgtataataaacattcatgtggcttaacatttttccatattcttacatagacataattattttaatacgagagttgtattttgtcaaccagatataactttgatttgcttaagcattctttttgttttgttttgtttttgtttttgggggggtggttttttgagatgtggtctcgctctgtcacccaggctggagaacagtggtgccatctcggctcactgcaacctccacctcccgggttcaagtgatactcctgcctcagcctcccaagtagctgggattacaggcacccaccacaactggccagctaattttttggtgtttttagtagagacagggtatcaccatcttggccacgctggtgttgaactcctggcctcaagtgatctgcccacctcggcctccaaaattgctgggattataggcatgagccacagtggccacttaagcattgtttattgaataaaaataatttcccttttaagttatgctgcaatatgtattcttgtgcatgaaattgtaagctttggcatgcattagggtattctttcttcaggtactttgattttagagagacagaactattagacttactagacatctattaggggaagaatttaactgaaataattattatcattgaaatgccaggggtttggtctaaggcccattgcttgcctcacagaagtccaatccctgagacaatgagtattgccagggaagaaggctttaactgggtgctgcaaccagggagacaagagagcagtctcaaatccatatcctcaattgactaaaattagaggtttatatagcagcaaaaaaaatgtaattatgtgtagggaaaacaggaattagtgaggggtattaaagaggagctggtcaacaggaagcagttggttggtttaggcagtcatgatgggtgagggggtctggtgtctcactgtccagatgcagtgatctggtaagtttcagttccttcaaaatgtctgggtggcctgatagttgatttcctaagaaaggaacttggataagacaaatacaattttctcaagttttaagactgagagggtgaatttctatgtttatataaaaaaatcataaatatcagttctatgggacagttgagccagtgtcattatgatcttccatctaatatctatttaaaatttaaaacatgatttctctaaagagtgaatttaatactataatgcaatagacttactatgaataaaagacagatttttttatacttaaattcagggtgcatgtacagatttgttacatgagtaaacttgtgtcaaggaggtttgttgtacagattattttatcacctgggtattaaccctagtacccattagttatttttcctgatactctttctcctcccaccctccatcctccaatagactacagtgtgtattgttcccctctatgtgtccacatgtcctcatgagttaactcccacttataagtgagagcacgtggtatgtggttttctgttcctgtattagtttgctaaggataatggcttccagctccatccatgtccctgcaaaggacatgatctcgttcttttttatggctgcatagtattccatggtgtatatataccacatttgctttatctagtctatcattgatggacatttagctggattccatgaaaagacagcttatttaaaaaaaataggagcccataaattttatcatttacctattaatgaaacctgcaaacctggaattaattaaaatactcttttgttggtactcattatgca

SEQ ID NO: 1933 - DNA, 3160 bp, Homo sapiens
tgagaatctaagggcataagttagataaccgtgacacctgttttaaattagccttcagaagcctccgacagctgagaaattatttaacagggaaagaattgagttcatgaataaatattaatattaaatcaccacttccctagatttaagaggaagggtgggggactcaccaatagatggaggcagcaggtgtcctggagatgccactgtgcagggctcagagaagccagctgtggggtgggactacggagccaccgaccattggtcacctcgttcctgtccaagccgagaggggactctgtccatcagggaggctggcaggtggcagaggcaacatccaagcagctcacggcaactcaacaggtgctcgtttgagctccaaccttcccaggctgcggtcttagagggagagagactccacctgagagctgcccaaagcatggagcagactcccacccccatccctcagagaggggccactgtcccagcccagcctggccccattgtgactttcatgggtccagcactgttacctccgtgggcccctgcctccatgtaaaaatggtaaaatgtttattttatgaccacattggaataaagatgtattccaaagatgtaatccaggctggatttgtaattctatattcattattattttattcatttttttccctgattttaaaaggaatcaaaatgaaaacatattttgggccctgggcacggtccctactgggcctgatggaggcggcaactctctggctggggtcggggtgacggatgcttgagccagggaagcaggaactggtgaggaggggtcggcttgggggtgagggtctccaggggatggcagagccacccaagggatgtgaggatctggaaactcagatcccatcctttaggtccagatcacagattgaaattaagtaagaatcatcaatttctatgaataacaaaagtaataataatgagtatgaatgaatagcacactctgctttgactgtcctgacccccttggcattcttcaaaagcctccaagcaaaaggaaaagaaactgccaagcacattccaggctcagggccttcgccttagctctcctggcctggcatcctctttcctggtatttgagtgactcgctctcccttcttcttgggtcaccatcctagtgaggttcttcctggcttttggatcgaaatagcccctctactccctttatccactgttcttttcccctccttaattttctccatagcacttcctgcttccttatattccactgcgtgacacatggaaacatagggtataatagaatatacgctgcatgtggcgaggtgtagatgtttaccaggttgtagggactttgtttcattcttctttgtgcacttagcatctagaatagtgcctgccatgcagggtgctcaaaaaaccctgaatgaatgaatgaatgaaacatgtctggcacatacatggcagttacaaccatctttgtgcctagcgctttgggttgctgagccctcagccttcagtgaggaggtattggccttcttccaccattgcagagactgaggcctggacatacaaacaagcatgccccacagtcatacagttaaggtagatcaatagcttccctggataaaacaaagtgtagacaggtccaaggtttgagcaaaaaagtggtttggaaggcgcagttatggaaggatgagggaataagggggctgatgatttcccttcctactccaggttcagcatttcagtttctgtctgcaccagagccttctaggctctttgttggaaactgtggatgtcacactatagctcatacttacttatacagaatttaatatgcacctggcactgttctatgcattttacatatattaactcatttaaggcttatacaaccttgatgagttctgcagtattatccccacttcacagatgcagaaactgaggcaacatgaagttagataactcgtttgatatcacatggtattgtggtaagaggcggatcagggatttgaaatcaagaagaaagacattggagttggggacactggtttaagtgcctgccctgcagaacctaagcagatctgttttcccctgggcctcagtctccccctctgtaaaggagggaactgggccacagtctgtgatccctgcatcgggcagggctgagtgctcccttcttctgcatccaggcttcccaccagggaagggaatgagccctcctccttgctgcctcccctcctcctagtccccggctcagggcctgatgcctgcaggtggtggtggatcctcggtcgtgcggcggatgtgttctggcatcatttaacacctgcctcatatctccgaagccccatcctacacgtagctgtgagcacatagctctgccgaactccaaatagacataagccactgccctgctcggcttcttgtctaattatggctgcgacattgatgtgacagggtgcgtttaattacaggaccatgcacactgacccaaacgctgttttggcccagaattttccagcttgagcagcccaaacgctgtgtgtgatgataataataaggacctttagattgtgctggggattaaatgagataatacatgcttctggcagggagcagggcaccagccagtgacctgtggtcaggtcccagctcctccttccccttcctgctcctgacatggatgcccactctgcctagccatgccctggaaagacacccatcctatcttggctaggcagaatgtcagctctgtcttttttgaatttgtcctccaaggatttgcagaagatgggaacaggggaggccttctgaatatagtgactcttctcccagctcccagaagcacatctggcttggcagcatctttgggccacccaaagccagggtcccttggcccaggcagcatttgggtcagtgtgagggccttcagtaagcacacgttcccatcttgacaccactgccatcactagataagacactgagagggacggcgggctgtgttcattttgtgtctgatgagctctgctataaaatgaggaaagcagttcagagaaattaagcaacttgcccagagttgtccagctaggaatttccagagctgtactcagattcagaactctgggtgactgccctatgccaggcaccccca

SEQ ID NO: 1934 - DNA, 2344 bp, Homo sapiens
attgtctccgaagtgagttacaatgaccaaaataacgttctgctttcaagataaagacaggcaatatttcggagttaatttcataaaaccgatcatccaaccattacctccctgtgtcgatgttaactgttgagtctaaaataacttcaactcctgcctcccttggtggccatggaacaggagtgatggaggttggctgtgacatacagctgtgttagatgggaagccactttacctttcccgatgctagaaaaaattattcatggaaacttctagcagcaattctctccccttaaggcacagtaaaaaaaaaaactagaaagtcaactggtttgattgggggtaggggcagagatcagtggatttaagggagttttatggtggtatccttggttgatcatcatggtggacttatagaatagggtcggcctttcctactgcccaggtctggtgttacacaagtggaataatgtgtctgtaagtggtttgtaaattatgaaactctgcccatgtctagactctttttttttttttttttttttttgagacggagtttcgctcttgttacccaggctgcagtgcaatggcacagtctcggctcactgcaacctccgccttccgggttcaagcgattctcctgcctcatccttctgagtagctgggattataagcatgtgtcaccacacccagctaattgcgtatttttagtagagagacggtttctccatgttggccaggctggtcttgaactcccgacctcacgtgatccactttcctcagcctcccagagtcctgggattacgggcatcagcccctgcacctggcctagattcttactattactaatacaattacgactactgtttattcttccccaagcaaaatatgcctgcttggtgtctcttcaccttagaagggtcatttcagatgaatggtgctgatgagtgtgatgagtgtgtttactcacccacccccaccacacacaccccagagagcattgcactgccacaggcatttcagaaaacacagcctcaaagtccacaaaaatgaggcactgatggtgggagcactggacatcattgtctacaggtgataacagaagagtgggagggagattggtgagccaggggtcttcgttgatgattctttgccacctggatctcctgtgaatacagtgggacacaggcaggtggcctcaccttacactgctcattctgttacctgactttgtatttgggattattctggcccaggaagtcatgtagagttgatatctgtgttcacagctgatctcccacctttgattgaacacttcctggggcatgggatctatcccaggcataggacacataaaaagctgctggcttttgaccttggccagagactgtaacagtgatgggaatggcgatgagaatggagatggtattggggttggggatgggatggaaatagaaatgagaattgagttggagatgaggatagagatgtgatagagattaagtgtggggacaggaatagaagtggtgataggaatggaggtgggatagagatgggggaggagatggagttgaagttggtcgtgagatggagacagaaatgaggagagaataggggatggagattgaggatggggagggatggaaatggagctgaatgtgaggatagagacagagatgagaatggagatggagtggagatggggatagaaataggaatggagatgaggatggggaaggggatgtggatgaggatgggatggagatagagatagaggtggagatgggcatggggtaaagataagaatagagaaggagattgagatcgagatggggaggagattgagatggggatggggataaagatgggggaagagatggagatggagatgggagtggggttggggatgggggtagatatgggtttggagatgaagatggggttggggatggtgataaaaacagggaaggagatggagatgaagatggagtggggatgagggtggaaatggggataaagataaggaaggagatgaagatggagatggggatggggatatggatgaattggggaaagggatggggatgaggatgagggtagggatgaggatggggatgggaacggagatgagggatgaggtgggcatggggatgggaatggagatgggggatgaggtggggatggggatgggaatgaagtggaggagcaggtggagagggggagtggggtgggaataggaatataaaaagggaagcctaagtgaaggaaggcttttattgggctatgaaactggcttttattgggctatgcaggcaggaatgccgtacttggtcaagagaagggaaaa

SEQ ID NO: 1935 - DNA, 7034 bp, Homo sapiens
aaattaaagcaagaaaccaaatccttttcctgtttactcctacagtttttccctctttccagttccttgtttttatggtttttcctgccttgtgtttctccgttggcttttgttgcaatgtatgcacttggaaaaaatcttctgaatgatcctagtgatggggctttggcctcattgggcgttgtgtgcacgatcgggttgcattgcacactgccggcgcgatgagctcgcactccctaaaaaggcaatcattgtgtccaggaaaactctgctaggttaatggcacatgcccaggggctgaagtcacttggaccaaggtttgtagaacatgctccgtgtggctttcctgttggggcagggggattgggccagaggaatttaggtgtattaacacagcctgccaggtgcaataaatagccacctttgcctgaccttaacctcacctaagcgccatgctcctcaagagccctgggcaccccaggagtaactgaaaacctttggaggagagttacgctggtgttcttgggttagaggcgggtggcaggctggagaattaggttggaaataaaaatgagtcagtgttggtgatgcgttttgtgaaaccggaaagcttagttagaatgatagagaatacataacctgttctcagcaactttgttttaactgacaacaggattttcccagttttcccactaatgtctcttttctgttctaggatccatctgggatccacattgcattttgtcatcagttcaccttggactcctccaatccatgacgatttctcagtatttacttgtcttcccgacctggtgcttttgaagagtagctcttaggtatcttgtagaatttggatttgtctgattagactgaagtcttggatttgggggaagaatcgcacaaaggtgaagcgccctttccctcacatcctacagggacacacggcaccaatgtggcttcttactgaggatgctgacctcgatcaccaggctgaggtggtgtctgcaggtttctcctctataaagttactgcttctccctctccctgctctggaagcaagtcactaggtccagcccacatccagggaagtggacttaggctgcccatcctggcaggaggaggatcaaagaattagtgggcctgaggttagaaccatcaccatcattagtaaatttggagagagatactcagaggctatgcagatatcctgtgtcaccctgacgtattcatccatggataggtcattcttcttttagtgtgagtatcaaaagcaggttattcggtgcaaccagtgaacttgagagcagggactgggaagccctggagttgtcgtggctcagccccgtgcccctggctgtgttccttccctcctcactgccaagatgctgctgagccctggtctcacaaacacctttgagtggtctgctcactgctggggacatggactccgacaccttcctacccctcaccgttcccctctcctccgacttgccaccgccaaagccagcagtgacaaaggaggtgccaggggcagctgctccagcaggagctctctctgtactccggaccctgacatggatgaaaacaagatatgcttgggagataattctgttaactttgtcttcttttgggaggtgtggtggctaaatacttgaatgaaggttttatgatgggtggaaagagtaacaactttcttcatcctaactcaatgtcactcttcatgatgtactcagttattcccttttagaaattatcttaaacaagggtgagcaatggaatgtgagaaagatcaaagaaatgcagagcagactaagaaagatgaaacatctggattgcagagaagggtgacctttccctagaaaatatcaacactaaatctttacaaagccctgtccactgggttctagggagcgctgcaaatggactggtccctaagctctggcctgcttctccactcctgtgagacagttaacttttttcttttccttagctctgttcctcgccgtggggactctggataacaacagacaacaacagagcccgtggtagcagcagcgaaggagttaatatgcaccatgtgtctaagcccttttcattttacttctttgtaaatttttaacatatttatttaaaacataaacatcgatattctgattagttcgcaggaacaattattgtcattagggaagatggaaatttactagctattttcctcctttcatttttaaaaaaaaatatatatgtattacatttttttcttcaacttttattttaagttcaggcatacatatgcaggctgtgcaggtttgttgcacaggtaaatgtgtgccaaggggatttgctgcacagatcatcctatcttccaggtattaagcccagcatccattagctattcttcctgatgctctccctccccaccccaccctccgacaagccccactgtgtgtgagaacatgcggtgtttggttttcctattctgcgttagtttgctgaggataatggaagccctttccttaactcattaaatgggtaaatgtttgcccccacaagcccgcattcgtattttgaagccctaacccccagtgtagctgtatttggagatggggtctctaagaaagtaattaaggttaaatgaggtcataagggtggggccctgatccaatagaattattgcccttgtaagaagagacaccagagagctcactctgcctccgcatgcacacacagtgtgggccgtgtgtgcacacagcgagaaggtggccgtctgcaagccaggaacttgctggcactttgatctggaatgttccagtctccaaagctctgagaagatacatttctgttgtttaagccacccagtctgtggtgttttgttacagcagcctaagcagactgagacaggcagatactatcattcccatatgaaaattgaagagactgaatcatagaaaggggtcgcttgctgtattgctctgttgatttttccttctaatagttttgctttctacatttactgtaatgttcagttcatcaaggctcctgaccatgatggtttgttgtaaacttccccacttaacagtatcctctgcttcctttttcctcatttgacgtttttcactttgaattctcctttctccaatgttagcatctgaaaccctttgtgttgggcaggataggccaagtctgatgctgttacaaacattctgaagacccataggcctacagtgaccacagcttctctcttgggcacactggaggccattggcggtgtgcagggcctctgcttactgtagtctcagtccctgcccaatgggacgtggctctcatggcttctgctgtcagcacagactcattcactggctcttaacacttctgcccagaagtggcacagatggtggaaaggtgccaggtgggctcctctagccaatgtgagggcctttgtacaaaggagaaaaggggaaaaagagcccacccactggtgcagggctaggagagtagagggtgtcccttccctcagatgggtgcccccccaccctgcagcagggttgagggagcagaagcggggtcctgccctgttgcctggtggccgggcactcgctgcatgcagggcggagggataaggagcagagtcctgccctgttgcccagtggccgggcaatcactgcacgcagggtggagggagcaggagcagggtcacgccctgtcaccccgtggccggccactcactgcaggcaggtggagggagcaggagcagggtcacgccctgtcaccccgtggccggccactcactgcaggcaggtggagggagcaggggcagggtcacgccctgtcgccctgtggccggccactcactgcacgcagggttttgctgtctttatgtcttcagggcatttccatgagaagtggaggctgctgccaagacagcatttcaaaccattcttgaagcaggaaccacatctgcgtgtgaatttttccagaatctgggggaagaacttacttgtttcttcgatattctaaataatcagtacagcttccgacagcagtggcctccaaacctgaaatagaggcagtgtatgagtccacgagtctttttgcttggttttgccttgcttgctttacttggattctgacactccactcgcgtgtttccacattcaattccatttgaatgactttggtgcttctcagccagctgtggacccggcagccctgagccctagcccttcccctagcagccaactcagcacccgtgttctaaggacgcaggagtctagaaatagctgcgattcagagcatgttttcccgacaactgctgattctctcctgacaccctaatgctgctctttccctattttagggattgttctttgctgaaattatgtggcacacatcaaaagtgttctacaagtgtccggggtgttcattgtaatctggtataacaagatgcctcacggccaggtgccgttggctcctgcttgtaatcccagtgctttgggaggccaaggtgggaggatcccttgaggccaggagtttgagaccagcctggtcaacgtaatgagacccccatctctacaagaaaaaaaaaaaagataccgcagttcacgcagttcaggtatttgttccgtgaacttgggggagtcatataaactcaacttttctttgtctctcttgcctgtgatgagtaacagaaaccatcttcccagaaactatccccacccacccccagcccagcccgagcagcccagacccaggaaggaggtcagagcctgcgtgactgtgtggcaaggatccccctcaaagcaggcagtgatccccctcaaagcaggcagtgatgaccaggctccccaggggaaggaaaaatggttgattaccccacctcactttctcaagttcctgaaagcctcccatcttttcaggatgttttccttctgcttcctttctggggtgatattgcaatgcatgtgtcagtcccattgttctagctgccttgaaggagttccagaaacaggcatggctggtgtgagaggaggcgtccttgtcaccatcctttgttgcctcccatctgtggtcagcacggaggctgccctgggtcttggccggcccctggagctggaggaggtgctgggccatggtttggaagctcgcatggtcccagcctcagagccccgttctctgtgacctggctgggtcaaagcctggccccagaacagcccctccctccccacccacagctgtgcccagctacgaacactgtaggccgggcgcgatggctcacacctgtaatcccagcactttgggaggccagggcgggcagataacttgaggtcaggagttcaagaccaacctggccaacatagtgaaaccccatctctactaaaaacacaaaaaattagccaggcatagtggtgggtgcctgtaatcccagctactggggaggctgaggcgggagaattgcttgagcccaggacgtggaggctgcagtgagccaagattgtgccattgcactccagcctgggcaaccaagagagattctgtctcaaaaaaaaagaacactgtggtgtgagaggcaattgtgggtcagcctgagggcacacccaatataactttcacaggtgttttgtttttctgagaagaaggtgacttttcccggttgctgtccatgcagactgtgagggatgttcacatgtcacatttctcaccggagtcctcgtcccatcgcctcctctctccctgccgcggttcggaagctccacgggggccagtgttgttcaggcctcaccagtccttggtcatgccacccgggctgagttcatttacctgctcattcatgtattcacttttcctccgattcaacaaaaaaaaaaattgattaccccccggcatgtcctaatatactgcagccttcgaaagagatgtagtcctcatctgaaaggtcatcctttcaagtgtccatccatccactgggcagatttttacttagcacattccctgtgctggggacttccccgggcactggggacactgtagtgcacaaaccgaagtccccacgctctgtgaccctgaagataaactgctgagcagacagctctgtaacatgccaagtgttggaaagggctccagaggaaatagggtggagagaggaacaagaagggcaagtggggaggttgctgttttctgtggggtgccagaggagggctcctgggaaaggtgatgttcatggcagtgggaaagacagcaggtgcaacagtggagaaggatgccagcctgacctgtctgactctcagcatgggggctgttgtggctgagcagagagatccgaaggaagagtggggagaaatgagggaggggagacagctgggggcgagactccctggggctgtgtaggcagcagtaagacttggattttccccctagcaagaggggtggctattggacagctcagacagaaacctggctgctctggcctgtgttaagaggattcctcctcgcactgtgtggaggacagccctggatggccgggcaggttacgcactgcagaagccctgggagcacccttcacactgactcctgtgtgaatgaccatcacagcctgggcggggctggctgtaggagcagcagaccagcaggggcaagagcagaagccagagaccaggctggacgttggcacagtgaccgcaggagagaagaatgttgccagaccagagtggagccatgggctgcagaggtggagaagtatttgcattctgtatgccttctgcaagtagagcctgtggggtttgctgatggattgaatatgggatgggagagagagggagatcaaagatggtcccggggttttcccctgcatgaccaaagtggatgttgaggtttgacctgtgccagtgtgggaagctgggtaaatgtcgggttctggggggaaacctggttgcctctgctgggcactcggccctcaggcctccacatcctccttgaaatgcgtatcgggtcactctggggtatgggtttctgattaggggagttcagaggcttattcacag

SEQ ID NO: 1936 - DNA, 5258 bp, Homo sapiens
aatgtgagaaagatcaaagaaatgcagagcagactaagaaagatgaaacatctggattgcagagaagggtgacctttccctagaaaatatcaacactaaatctttacaaagccctgtccactgggttctagggagcgctgcaaatggactggtccctaagctctggcctgcttctccactcctgtgagacagttaacttttttcttttccttagctctgttcctcgccgtggggactctggataacaacagacaacaacagagcccgtggtagcagcagcgaaggagttaatatgcaccatgtgtctaagcccttttcattttacttctttgtaaatttttaacatatttatttaaaacataaacatcgatattctgattagttcgcaggaacaattattgtcattagggaagatggaaatttactagctattttcctcctttcatttttaaaaaaaaatatatatgtattacatttttttcttcaacttttattttaagttcaggcatacatatgcaggctgtgcaggtttgttgcacaggtaaatgtgtgccaaggggatttgctgcacagatcatcctatcttccaggtattaagcccagcatccattagctattcttcctgatgctctccctccccaccccaccctccgacaagccccactgtgtgtgagaacatgcggtgtttggttttcctattctgcgttagtttgctgaggataatggaagccctttccttaactcattaaatgggtaaatgtttgcccccacaagcccgcattcgtattttgaagccctaacccccagtgtagctgtatttggagatggggtctctaagaaagtaattaaggttaaatgaggtcataagggtggggccctgatccaatagaattattgcccttgtaagaagagacaccagagagctcactctgcctccgcatgcacacacagtgtgggccgtgtgtgcacacagcgagaaggtggccgtctgcaagccaggaacttgctggcactttgatctggaatgttccagtctccaaagctctgagaagatacatttctgttgtttaagccacccagtctgtggtgttttgttacagcagcctaagcagactgagacaggcagatactatcattcccatatgaaaattgaagagactgaatcatagaaaggggtcgcttgctgtattgctctgttgatttttccttctaatagttttgctttctacatttactgtaatgttcagttcatcaaggctcctgaccatgatggtttgttgtaaacttccccacttaacagtatcctctgcttcctttttcctcatttgacgtttttcactttgaattctcctttctccaatgttagcatctgaaaccctttgtgttgggcaggataggccaagtctgatgctgttacaaacattctgaagacccataggcctacagtgaccacagcttctctcttgggcacactggaggccattggcggtgtgcagggcctctgcttactgtagtctcagtccctgcccaatgggacgtggctctcatggcttctgctgtcagcacagactcattcactggctcttaacacttctgcccagaagtggcacagatggtggaaaggtgccaggtgggctcctctagccaatgtgagggcctttgtacaaaggagaaaaggggaaaaagagcccacccactggtgcagggctaggagagtagagggtgtcccttccctcagatgggtgcccccccaccctgcagcagggttgagggagcagaagcggggtcctgccctgttgcctggtggccgggcactcgctgcatgcagggcggagggataaggagcagagtcctgccctgttgcccagtggccgggcaatcactgcacgcagggtggagggagcaggagcagggtcacgccctgtcaccccgtggccggccactcactgcaggcaggtggagggagcaggagcagggtcacgccctgtcaccccgtggccggccactcactgcaggcaggtggagggagcaggggcagggtcacgccctgtcgccctgtggccggccactcactgcacgcagggttttgctgtctttatgtcttcagggcatttccatgagaagtggaggctgctgccaagacagcatttcaaaccattcttgaagcaggaaccacatctgcgtgtgaatttttccagaatctgggggaagaacttacttgtttcttcgatattctaaataatcagtacagcttccgacagcagtggcctccaaacctgaaatagaggcagtgtatgagtccacgagtctttttgcttggttttgccttgcttgctttacttggattctgacactccactcgcgtgtttccacattcaattccatttgaatgactttggtgcttctcagccagctgtggacccggcagccctgagccctagcccttcccctagcagccaactcagcacccgtgttctaaggacgcaggagtctagaaatagctgcgattcagagcatgttttcccgacaactgctgattctctcctgacaccctaatgctgctctttccctattttagggattgttctttgctgaaattatgtggcacacatcaaaagtgttctacaagtgtccggggtgttcattgtaatctggtataacaagatgcctcacggccaggtgccgttggctcctgcttgtaatcccagtgctttgggaggccaaggtgggaggatcccttgaggccaggagtttgagaccagcctggtcaacgtaatgagacccccatctctacaagaaaaaaaaaaaagataccgcagttcacgcagttcaggtatttgttccgtgaacttgggggagtcatataaactcaacttttctttgtctctcttgcctgtgatgagtaacagaaaccatcttcccagaaactatccccacccacccccagcccagcccgagcagcccagacccaggaaggaggtcagagcctgcgtgactgtgtggcaaggatccccctcaaagcaggcagtgatccccctcaaagcaggcagtgatgaccaggctccccaggggaaggaaaaatggttgattaccccacctcactttctcaagttcctgaaagcctcccatcttttcaggatgttttccttctgcttcctttctggggtgatattgcaatgcatgtgtcagtcccattgttctagctgccttgaaggagttccagaaacaggcatggctggtgtgagaggaggcgtccttgtcaccatcctttgttgcctcccatctgtggtcagcacggaggctgccctgggtcttggccggcccctggagctggaggaggtgctgggccatggtttggaagctcgcatggtcccagcctcagagccccgttctctgtgacctggctgggtcaaagcctggccccagaacagcccctccctccccacccacagctgtgcccagctacgaacactgtaggccgggcgcgatggctcacacctgtaatcccagcactttgggaggccagggcgggcagataacttgaggtcaggagttcaagaccaacctggccaacatagtgaaaccccatctctactaaaaacacaaaaaattagccaggcatagtggtgggtgcctgtaatcccagctactggggaggctgaggcgggagaattgcttgagcccaggacgtggaggctgcagtgagccaagattgtgccattgcactccagcctgggcaaccaagagagattctgtctcaaaaaaaaagaacactgtggtgtgagaggcaattgtgggtcagcctgagggcacacccaatataactttcacaggtgttttgtttttctgagaagaaggtgacttttcccggttgctgtccatgcagactgtgagggatgttcacatgtcacatttctcaccggagtcctcgtcccatcgcctcctctctccctgccgcggttcggaagctccacgggggccagtgttgttcaggcctcaccagtccttggtcatgccacccgggctgagttcatttacctgctcattcatgtattcacttttcctccgattcaacaaaaaaaaaaattgattaccccccggcatgtcctaatatactgcagccttcgaaagagatgtagtcctcatctgaaaggtcatcctttcaagtgtccatccatccactgggcagatttttacttagcacattccctgtgctggggacttccccgggcactggggacactgtagtgcacaaaccgaagtccccacgctctgtgaccctgaagataaactgctgagcagacagctctgtaacatgccaagtgttggaaagggctccagaggaaatagggtggagagaggaacaagaagggcaagtggggaggttgctgttttctgtggggtgccagaggagggctcctgggaaaggtgatgttcatggcagtgggaaagacagcaggtgcaacagtggagaaggatgccagcctgacctgtctgactctcagcatgggggctgttgtggctgagcagagagatccgaaggaagagtggggagaaatgagggaggggagacagctgggggcgagactccctggggctgtgtaggcagcagtaagacttggattttccccctagcaagaggggtggctattggacagctcagacagaaacctggctgctctggcctgtgttaagaggattcctcctcgcactgtgtggaggacagccctggatggccgggcaggttacgcactgcagaagccctgggagcacccttcacactgactcctgtgtgaatgaccatcacagcctgggcggggctggctgtaggagcagcagaccagcaggggcaagagcagaagccagagaccaggctggacgttggcacagtgaccgcaggagagaagaatgttgccagaccagagtggagccatgggctgcagaggtggagaagtatttgcattctgtatgccttctgcaagtagagcctgtggggtttgctgatggattgaatatgggatgggagagagagggagatcaaagatggtcccggggttttcccctgcatgaccaaagtggatgttgaggtttgacctgtgccagtgtgggaagctgggtaaatgtcgggttctggggggaaacctggttgcctctgctgggcactcggccctcaggcctccacatcctccttgaaatgcgtatcgggtcactctggggtatgggtttctgattaggggagttcagaggcttattcacag

SEQ ID NO: 1937 - DNA, 2405 bp, Homo sapiens
ggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaa

SEQ ID NO: 1938 - DNA, 229580 bp, Homo sapiens
ttctcagcatgccgatctatttactgctaaattgaataattccgcctaaaggagataacatactcttactgacagcttgtccctaaactcccagatttcacaacatcagtacacaaatatacaatatagaaatggttgcttatgtgcattagatctgatgtaaacaacagctgccaaaaagactgaattagcctgatcttatttcatttctcttcttatttcatttcttttcagtgatatttgcctttttaaaaataatcagttgtggcaatacgtgaagcggagaggcacagataacaggcacctccattacaccaatgacggttctgcagtttttcctaaagtctttctagaatgacgcacaacacattatagcttccgtgtttgctcaagattatttgattaaactattacactgagagtaaagattactctttttaggttgtcactttctcactgatgcttggcaatttacttaagggaataagctaggtgtaggtttgcaccccttgctctatcaagacaatggcaaatattgattggtagtaagtaaggcttagacgtggtttcctttttcttttacatcagccgtgggctgttgagatacaataggtgcagccaaaactgactgataaatatggatttctaccctcccacagggcttggaataatgattgagttgctttgttttttccagaacttatagcatatatatatatacatacacacatacatacacacacacactatatacacatatatttataaaatatataaatatatatgtgcaatatatatacacatatacaaacatatatgcatggtatgtatatagatgtacacacacacacacacacacacacacacacatccttctttgatggctccacttcccatccaattgctcaatcccaaatctggaattgccttgacctatctctcttttcctctgttactcaaagaaatcttaaaacttggctcattctcatctctcctgtcgaccattctagtctcagccactatcatctctcccctggactataccactgcaatctgggaaccagtgggtttcctggcttccattcttcctcctcaagcttttctctgtatagcagctgaagtaatcatttaaaaatactcctcttaaaaaaatcctccccacatggtattacacatggaaactgacagtccaaggctgtgatcaggcgatggtaggctcaactgggccagtccaagtgacatccctttgaaaggagcatagggagtgccctgccccaaaacaccccccaacacaaaacattcagcaacttcttttaaaaattatttgtataaatttagggagtacaagtgcagttttgttacatggatatattgcatagtggtgaagccccggcttttagtagaaccatcactcaaattaggtacattgtactcattaagtaatttctcatccttcactccccttcctgcttcctcccacccttccgagtcttcaatgtctatgaattctatagtcttgtcttcacactgttttgctcctacttacaagtgagaacatgtggcatttgacttcctatttctgagttatttcacttaagacaatggcctccagttccatctgtgctgctgtaaaagacattattttattatatatttttatggaccagtagtattctgttgtatatattatagtataccatattttctttctccagtcattccttgatagatgcttaggttgattacatatctttgctgttgtgaattgtgctgtgataaacatacaagtgcaggtatcgtttttatatagtgatttcttttcctttgggtagatgctcagtattgggattgctggatcaaatggtagttttattttttagtactttgaaaaatctccatactgttttccatagaagtactaatttgcatttccacccacattgtataaacgttcctttttctccacatcctcgccaacatctcttatttttttgactttttataatagccattcagactggtgtaagatgatatcttattgtggttttcatttgcatttatctgataattggtgatgtctagcattttttcacatgcttgttggccatttttatgtcttcttttgaaaaatgtctgtttgtgccctctgcccactttttaatggggttatttgttttctttgtcatcgttgattatttaagttcctcgtagattctagatattagtgctttgtcacatagtttgcaaatactttcttctattcttcaggctgtctgttcactctgttgattatctctttttctatgcagaagtttcttagtttaaatgaatctcatttgtccaaaatagtttttgttacttgtgcttttgaggtctcagtcatgaattctttgcctacggcaatatccagaagagttttccccaggtttacttctagtatttctatagtttcaggtcttacatttaagtctttaatctatcttgaagtgacttttgtatatggtgaaagatagagatccagtttcatcctcttgcatttggcaaccaaattttctagcaccatttattgaatagggtgtcctttctccagtgcataagtttgtcaacttagtctaagatcagttgactgcatgtatgtagctttatttctgggttctctactctgttccattgacctatgtgtctatttttataccagtaccgtgctgttttgattattgtatccttgcagtataatttgaaatcaggtaacagtgatgcctccagctttgttctttttgcttaggattaaatttggctatttgggttcttttttggttccatatgaattttagaattgttttttctaattctgtggaaaataatgttgggattttgataggaattgcattgaatctgtagattgctttgttaagtatggtcatttaaacaatattgattcttccgatctatgagcatgggatagtttttcatttgtttgtgtcatttacttgtgtcaatttctttcatcagtgttttgtaatttccctctcagagatctttcacgtccttcgttacatatattcctatttattttattttgtagttattgtaaatcagattgacttcttcatgggttctcaacttcatcattatttgtgtatacaaatgctactgatttttgcatgttgattttgtgttctgcaactttacttaattcattgatacaatcaaatagtcttttggaggagtctttaggattttataggtataagatcatattgtcagcaagcagagataatttgatttcctcttttccaatttggatgcgttttattttttttctcttgactgactgctctggctaggacttgcagtattgtattgatgaattcttcttacggaaaagtggaagttctgctatatcaaaaagaaaagggggctgggtgcggtagctcacgcctgcaaccccagcactttggaaggctggacagatcatttgaggtcaggagttcgagaccagcctggccaacatggtgaaaccccatctctactaaaaatacaaaaattaactgggcgtgatggtgcacacctgtggtcccacctacccaggaggctgaggcaggagaatctcttgaacccaggaggtggaggttgcagtgagccaagattgccccactgcactccagcctgggtgacagagcgagagtccatctaaaaaaaagctggctgggggagcgggggaggaaagttccataggcaaaaacaataagtctctattatatattcatgatgaaattctcattggtccaaaatgaaatgaaaaatataaaaatgatatattaaaatttttatacaattcattatgagtttttatattttatataaaaatgatattttgaaaatttttatgaggctaaatagggttaatttttaaatatttattttttactgccctttactattcttttttagttttggtgataaaatgtcctttcatttaatatgttatggtgatatcagtttacagttatctttttatgtctttacttggcaaagttaggttaacaactctatgacggtttcctaatatattgtttaaatttatttgttcacaatatccaaacctttgggaatccttaatctagagcacattttaccaaagtgccacctaaattgcagttggaattgcttgcaagaaagaagggtgggagaagtttactgtcgaatatactcaggatgctgagataagaaacttaaaaaaaaaaggaaccttaccacagaacttctcacagccttaaacatgctgatgtagatggtgaatccccaaaatgaagatacagtatacagcatatcccacaattatttgaccaaggaactcttgcacgaagaagcatcttagagacttgtcctggaaagtgttaatctagagactcacaaaatacttcaacaaatattgaatattggctggcaaatagaaatgcataatgacacttctatagaaagaggaatccaagggacataaaagaaattaagatgagaattcagagatttgtgccatgtcatcctcgactacagccttagtattttcaacttactggtttcttagcttggtctgcatatttgtgaaagaataagccccattcatacgcttatattttcccaaatgactttgaaatgtcaagccattgtatgaatttgaaacggcatctttagacctttactgaagttatgttactgttgccggagtaactaacaagtatcacagggcaggggaaggcagaaaaatatcctttcatttatcaagcactgaataaagcaagaggcttagaaatgtgcgatggaacacgatgttacaaagctattgttcctgtacctgtaaataaaaggtaacaaggtccatttgatgacaaagagtcatgagacagctacacagctcctcttcaaaaggaaacaataaaaacttttaaaaataccaaataacattacacttcttgctctaaaagtatgctggttatataacagaatgcaagtagatttataattagcacttgtttatagatgtcttatactgtgtcatgcatggaggggcaaaagaggttctgatggctattcattcagatagaagttatcgaggccataggaagtgagagcgccatcatactaatgttaaatagactgaacaatgggaaatttacaaccagcacaaggatgaatcagttgatgaatatcacattgttgatagaaaacgattttgagagagtggagcaaaacttatttaggaagttagaggcatctctcctattctcttcttccaaccctccacttcttctcgtatttaagattaatagataattagggtagaatggatgctctttaaaagagaaagcactgaacaggagagattgtgaaggttttttcatgctgtggactcaggatgcaagaggggctgtaactctcaggatacaatgagaagaggcatcatcctttctggggtaacatttggcagtatagagctagaatagcaacattaagggtagcaagattaacagcaagaatacagggatcagaaagtctgaagctcgaaaatgctctgaaatcaagtgaagtgatgtaaagggaatatctaagttcatttctataatttctaggccagatagtttgttaaaatatggaagaatgcagggatgcaaaatttctccaggtatataaacagcataaggaagtaaaaaaaaaatatagtactctgagataatttcaaggaaacatctataggaattcggagaagggaacatcatttctggttgggataattatgaaacatttcggaactgggatatagctcaaaatacactcaaaataattatgtggtgggctttctcgatgacatctctcagagtggctgagaattctaaggtgtgtcaaaattctgtactaaaatttatggccaaatcaacttatttgatcaccaatactgccattgccatcagcatcaccattaccaccccaacactgctatcaccatcattactaccaccacttccacccttatcagcaccactatcaccattatctccagcaccaccacctccatcaccatgaccatcattatcatcatcattacagctaacagttatcgaatgcttactgtatgcttaacaccattctaacccctttacatgaataagcaaatgtaagctttcttcaaaattccaggtgaaatgctattttctctggatatgccccacttcgttgaattatcttcccttcaatgaaattttctctttctctgtaaagttctttaatggaaaaatcactttccacattatactatagatgtaagttacttatttcccttctttaaggacagattatgcctgattccacttcaagcctctcaaagtacccagcccactccttactactaattgctcaataaacttatttgtgttaaggaacaaataaaaagataattcctacggatacaatatttttaagattgactctcattttggaatacaaacatgacattgtatacaaagcaagagtttagttaccttcatccatgtcaaactatgtctttaaaattcacagaaaataaaagaaagacaagttacacataaaccttatgtcagttgtgatgcaaaaatatcagatgatcatttacacattgaaagaaacacaagtatagaatagttgcattatcaaatatttctacaaaatattattgatttataacagattttattcataagtcctgccactgctggtataaaggcaaagaaatatcatgtaggaaatatttcggctgcagttgttggttgcttgctgtggtggtggttgttggccttagctacatttattacatccaaaatatagagcagcgccaagatctgtctaagtcccatgcttacacaattagcatgcttctcattctaaaaatacctttgtccagtgctgtttgagaaaccagcagagtttttctaataatcttgttaaattacatgataagtaatccattgcttcaccttacaaagggatagttaggaacaaggattagatggtttgcctaagtatgttgtagtagagactagctgaaactatcttcttggatgcataggctgcatatgcctagcttgccgtgcagttagatggggccacatgactgagtaccagccaatgtaaggtgaacagaaatgtttagtccttctctataaaaaacctccaaggtgtcaacctccagttatttttgcctgttgcactccactaacaagaatggtgattgtgggagctacatacttaagttgaaaggacccacaagatgaaaaaagcttgagcccctgagtcacaacctggaagagaactgactagggacataggtttaagactttatatgagtaagaaatatgcttctgtcataataaatcattatgatttgaggatttatctgttaaagtagctaaggtatattaactaacatggacattattatcttgaagtggaatgttgctctaataaaagccttcaataggcttagtcgttatggagtacacggctaggaaatacgtatcagaagctggtaagatagagatgtgttatttggagacaaaacatttgttaagtctatcatctgcaatacatgttcctacatgtattgaccaactaaatcttcaattagcctctaactctgggagaagtaggtagggaaagttagaatatctgtttgtatgcatatttataacagcataattcacaattgcaaaaatatggaaacaacctaaaatgcccatcaatcaacaaatggaggccgggcccagtggctcatgcctgtaatcccagcactttgggaggccgaggcgggcagatcacaaggtcaggagttcgagagcagcctgaccaacatggtgaaaccccatctctactaaaaatacaaaaaaattagccaggtgtggtggcaggcccttgcaatcccatctaattgggtggctgaggcaggagaatctcctgagcccaggacgtggaggttgcagtgagccgagatcacgccattgcacttcagcctgggcaatagagtgagactccatctcaaaaaaaaaaaaaaaagtggatacagaaaatgtggtatatgtacaccgtggaacactactcagccataaaacagaacgaaataatgacttttgcagcaaattggatggagtcagaggccattattttaagtgaagtaactcaagaatggaaaaccaaatattgtatgttctcacttataagtaagggctaagttatgagcacacaaaagcataagaataatacagtggactttggggacatgggaggaggtgggattgaaggataaaagacagcattttgggtacagtgtatactgctcaggtataatgggtataccaaaatctcagaaatcacaactaaagaacatattaatgtaataaaatgtaataaccacctgcttcccaaaaactattaaaatcttttttaaaaaaatcagtgtgtatttgttacagttggctgctgttggtatgttattgccataaaaatagataaacgaaaaataaagatgttcttaggaaagaattggctacttctctagctgagttagaagtgattggagatcaagccccttgtagggttagaaaatccagactgtttatatatatcaaatagcaaatagtatcttggagtaaaaagatatttcagttgaaagaaatgattcagccctgcaacaaagactcatttaaaaacgttaccttcccactcaagcttgtactttcacaaggccacaacatatccataattatgttgagaaagaagcactgggcaaaagaagcaatgaaagcagatttgacaagtatagttaatagaaagtttgggtataattgctgacatagggagctgactgaaagaacaaacatcagaaattcctaagttcttgagacaattatgctgtcagaaaatccctgagcctggattttgccaaagcagttgacttcttgaactctaagacaacacttaggtctgccaatttgtaccagcctgagaagtgggcaatgaacgtagggtagccagcctgatccactcatgcctgtgatcctagcactttgggaagccaaggtgggaggactgcttaagaccagcctgggcaatacagcgagaacctgtttctacaaaaataaaaaattagtagggcatgcatttgtagtcctagctacccagaaggctgaggcaggagaatcacttgagctcaggagtttaagggtgcagtgagctgtgatcgcaccattgcacttcagcctgggagacagagcaagatcctgttgaaaagaaatagaaagaaaaaaaagaaaaggaaaagaaaaaagaatgaaagtcaggcagctcgtcaaggagagaatgtaccacaatgcccacttccgatgttgtgaccacagagaaggacagacaaaagaatacatctgtgtgtgaagatctaatcaacagatttcccccatttctgaagttgacacattcaggacacctgcccagcaagaatctgtagttgcattggtccagggaatgctgtctgcctcccattcttcacttttcctaattggaatttattagtgtgcttaacctttctctactgtgggatcaaacactgggcatgaggtgtgggttgtgaggagagggtaactaactggtccttctgttcatagataaaccacaaggcgccatatctcgttctgacagatggctgcacatcactggaaggatcttattcgttgaatcagacacagaagcagaatgggatttggggttgtctttggcacatgggtggtttataggtgtgttctatgtgtgagaagaaaaatgaaacagatatatggaaaccagaaggtagatttagaagagattggtcagttgatcactgaactcatttcttttttttttttcccccttggcatgcagcaagacagaatttctcatgctccttcacagttagttgtgatgtacaaccgagtttcaacacttggaagtaagtgaaatgaaatgggctgctttctaggcctggataggaaaatcccctgcccacgattctccatgctctttccccatttagcttgatgcaaacaagccagagaccttgaaggctagctggtgacgatggcagagccataacatggaaggatgtttgatctatgaatcgccacttggagaaccgacttgctgttcaggaacacccgctttggaaattacatgttcaataaataaacctgtgttaagacactaagattcagggactttgctgttagagttgatgggattaccttaaccacacacccacaactggtttaatagaagattgaatgtaaaatgatttcaagtgcccaacggctgaatttcttaatatgctatcctaagtctcatcatgatgatacactaggaatgacagaaatcagtcatatggactctttaagacagtttttccctgcaggaaaactgtgaagagtatcacctgaggtggccacatctcctttagacccctctcagcctttcagcgttttctgtaaataaagtccattcttcagaaaactttcaactaaactttgatgagatagagccaccagaaaagaaaaatcatgtatgctgtaaccactagaccaaggttcttttccaaagaggtttgtcgattttgataaatgtacttctaaatatatttgacatacataggcatcgggtgtttaatgaacagctttttctgctaaacgtcattttttccaaggttctcttacaaggagcttgacatgtgtagatgattatgagaatatatgtagactcactttttacttttctttttatttatttatttatttacttatttatttatttatttaagactgagtttcgctcttgttgcccaggctggagtgcagtggcgcgatctcggctcactgcaacctctgcctcccaggttcaagtgattctcctgcctcagcctcccaagtagctgggattacaccatacccggctaattttgtatttttagtagagacagggttttaccatcttggccgtgctggtcttgaactcccaacctcaggtgatccgcccacctcggcctcccaaggtgctgggattacaggcgggagccactgcacccaggcttctttacttaaaaacaaacaaacaaacaaacgaaaagctttctattctcagaagtgttcttgccctggctattataaattttccctgttctatctaaccaacagaatgtattactcttccctgggaacatgcacgtgcaactccctctcatgtaaaaattgccatattatccaagaagagtgtgtacgggtgcataattcaattaaatatgtagttcagaagcaaaagtaaatataagattgtgctaaggttcatgaattcaaagtttaaatactgagactctcagaaaatgtaaaatgcttttaaatgtatatatttattctgattattaccttttgaaaatgaactgaaaaaagacctacttaggaaacagaaatacttctgagatattgataagcggcttattatttttattgcttcaatttttagttttatgaattactctccaccacaacatattactggaaagttaagttttactgcggtgatctttcactaaagtctaattcattctaatcatttcaaaattcagagtttggtgttccatatttttgtcttccttgtcagttcattttgtatattatttacttgataagctgaggcttgaaaaaaatactcgcaaaagcttgtctgtacttatggccctgggcaggagtacaggcactttctctcatgagtattttacataggaatgatccagagaagagatgtggccctgtctctaccttgacagtaagctccaaatgctgacatttgctgaagtaaaaattctccctgtctagtggcaaaggtgcccccattcctttgaccccaaaactcccacttcccccaatcttcccatgcagatgttgtctgcagaaatgaagccatcaggcatcagaccccaaagcagacttaggtcgcatttacacattttctatcacaagcaggataaagacagactcaagttacccattacatttaggacttggggctcttagcacccaggctcagggttttaactcaggacacttacaatgaactaactcagtactacctttggtagtactacctttgagaactaggttccctgctagactttgaatttcttgaggattgggggcacatcttatttgttgttgtgtccctggaacctaccaagtactagagcatcgtgggctggctgtaaatgtctgtgggatgacttagtaaatgaggaaggcgagacatccttgaccaaccatagtgactaagatactgcagtggaacacctgctgttcctagttaactaagtaaatatggatctcccatagtatatagagaaagaataactctaaggaagaaggggataatggctgcgattccttccaaaagaacgctgtcacatgtgtgggggcgctgtacatatgtatcatctcttaactacaatctatgcatgtagtttgtttacagagatatttcatgcatgctgtagaaaattcaggtcatataaaaagggattataataaagctaaaatcccctaaaagttcaccactcagaagaactctcccatcaacatttgtatggggatcacccaaggtcaatctttctgggtatgtctgtgtttatgcttcctataatttattttgatttatgtttttgctgtatcacttctgcttctcaccctttatgacatgatggagatatgtctcttttttattttactagtagtcacttttataactttaaatagcatattttaacaaagttcttaatatattaagtacagacataaaataatacatacagaaaaaaaggcacataaaagaccaggaatagcttactttctctcatcttcattttattggagcatgcttcaagattatgtcccttggccgggccgggcttggccgggcgtagtggctcacacctgtaatcccagcactttgggaggccagggcaggcagatcacctgtggtcaggagtttgagtctagcttggccaagatggtgaaaccgtgtctctactaaaaatacaaaaattagccgggcatggtagcacatgcctgtaatcccagctacttgggaggctgaggcaggagaatcttttgaacctgggaggcggaggttgcagtgagccgagatcacagtgagccgagattgcaccattgcactccagcctgggtgacaaagcgatactccgtctcaaaaaaaaaaaaaaaaggattatgtccctttatcctagtgtaattattattactttatattgtatggtatacttgctttcttttgtacagccaatatttccaatagatattgtgaataattgtttgctcaaatgactttaatctcattactagtccactcattctacacgagtttttgaaattattatcactttccagttcagtagggtatatctgatctatttcctgagtctttaaaatgttctgaatctttgaatatttattcatatatttctattttctttttatatgagctataacttaactggttatataatacttttgttacactattttgtctcaaattgtgtagctgttgcttcattgtctttgggacacaatgctgctaaggaaaaagtctggatccaggctaatttttttctctatgatattgttgaccctatattgttactttgtatttttgttatttgcatttttcgttgttgtgttcttattttttccccaatattttcaatctatggttggttgaaacccgctaatatggagggtcaactatgatatgatattaatacatatatagatatatcatatataatattatatagttatattttatatattatattagttatattttatatattataatattatatagttatattttatataatacatattataatacatagttatatttatataatattatgttatatctatatatagatatgagaaaaagcaaaaaacaagaacaattaaaaaatataaatacaaaaacccagtagagtataacaactatttatgtagtatttacattgtgttaggcattataagtaatctagagatgttttaatgtataagggaggatgtgtgtaggttatccacatatattatgccattttataaaaaggacttgagcatccacggatattggtatcgaccagggtcctagaaccaatcctgtgcagatactgagggatgatgtatattcttttgcatgtatgcttgtagaaatatttctaaatccttgcatttcaacaacctactacaatctttgtgctacttgctttgtgatacacatgcttagaacatcttgcctcatcttgatctgcagatttgggtttgaattaatttctttctttttgttttttttgttttttttttttttggtttgagatggagtcttactctgttgcccagggtggagtgcagtggcatgatctgggctcactgcaaccccgcctcctgggttcaagcgattcttgtgcctcagcctcccaaatagctgggattacaagtgcacacaaccacgcccgcctaatttttgtatttttagaaacggggtttcaccaaattggccaggctggtctcaaactcccgacctcaagtgatctgcccgccttggcctctcaaagtgttgggaatacaggcatgagctaccgtgccctgccctgaattcattcgtttgtttgtttggtttttaagacaaagtctcattttgtttccctggctggagtgcagtggcacaatcatagctcactgtaacctcaaattcctaggctcaggcaatcctcccatctcatccttttgagtaagtgagactacaggttatgccaccatgctcagctaattttaaaatttatttattttttttgtagagatagagtctcgctatattgctaaggttgatcttgaactactggcctcaagcagtcttcccacctcagccacccaaggttctgggagtacaggtggtaagccaccacacctgacttgtttctgttgttgttttgatattatcttcaggtataacaatgatccataagcttgatatttatttcgtgcctccatatctataatcttctcccttattaaataagttaacacaagaatttagagcaatgctttacacagaatatatgttcaaaatataaattattataactgattaattgttttaactcttttttccctaaactctggctgattttctcagtcttctccttcctatcactgactcagctctgtagtgctgattctgtacttcgagtttctaaagagcttttaatttccatgatggcaattactttctcttcagtttctttccttaatatggctagctgcccttaaagtgaattcacttaaattatcgtctcatctttgatctcttcattcagaacagtagatgatataccttaaattttattaaattcctccatgttggaaaacacttgtctaaaattttcttctaattccttgagtgtgctttcctccaaaatgtgttcctgaattaatcttctgcatgctagactttttttcttttaccctttggctaccttctcttttgcataaatttaacataggcaagatattttatgtctaggtgtctttgtatttacttacttatttatttatttatttttgagacagagtctcactgtgtcgcccaggctggagtgcagtggtgcgatcttggctcactgcaacctccgcctcccagattcaagagattctcctgcctcagcctctcaagtagctgggattacaggtgcccacaaccatgccaggctaatttttgtatttttagtggagacagggttttactatgttggccaggctggtcttgaattcctgatctcatgtgatcctcctgtctcagcctcccaaactgctgggattacaggcatgagccaccgcgcctggcctgtctaggtatcactgaacagtgaacgctattctacgcaggcttgccttttgcccaaacataaaatgggtggattctcattgcaactcctccttgttttcctgtaccttgcttgaaaaatctcatttgaaaaggaccaggaagtctccctgtggtttctattctctttaaagtatttcaagagagaggttttcagggaaggcaaaggggccctggagttctattcaggggattcctctcttctctcccctccatcagttggtctgaatccccagtaatatgggccagcttcacacaattgaaggtgtgccctggtctatggaaagtacctttggcatttagactttttttctctttggagtagggctgttatgcttcctgtgagatccttgtggtttatgagtttagggtttttttgtttgtttgttttgtttttcatatttcctaccaagcattttgttttctgctgagatttggggtagatccatttttcaaaaaatttcaactttatttcaggttcagtagtacatgtgcaggtttgttacgtgggtatattgcataacactgaggtttggggtacaaatgatcccatcaaccagggagtaaacacaatacctaatgggtagtttttcagccctgacccccccccccttttctagtcatccccaatgtctgttgttcccatctttatgtccatgtgtacttaatgtatagctcccacttccagaaaaccaaatactacatgttctcacttataactgagtagagccattgatcctcaaagatttgtctgtttccttagttagccaaaggggaaaagtggccaaacttttgatatcattcaagtgaaggccttgaaaaaccatttgtcttcagtggggaaaaagaactgcaagtgggttattctacatcttttcttcaacggccgacacctccattcttggtcttaacaaattttgaggataccagtcagcgatgatgagtatctgaatatatgtgactctctcatgggcaggaaaacaccctactaatctttgtacacttggtgcccaggtgctatgcatacagataaattctcccttaaagggtaatttgaatgccatatatatcatctgtagacagatgatttttctgcttgtccttagccacttaggttttgtctcttcttcttcaatctggcaatttcctatatatgaaatgtacaccagccagtagtgcaatttcaattcataaatgttacgttctactgcccatagatccccaaatgagctcatgaggaacttagagtgaagcgaaatgccagtggacctcctccaaaggcttgttcctccaacagcagcaaattttgtgagcagtccatgaaccccaagtctgagagatcagtctcagatctatctaattgcagggggctgtagagacttaaagcctgtatttattatcttaattaccttttggccagggcaaaaggagatgttatatagacaaccagttgctttgaggtttgcactgaatccacgtatctccgtagttgctcccaaccaatgatgaagcacagcccagtgactaaaatgggctatttctgggaaacataggatgctcccatggtgattttagcttcatagtttccccacagccttgctgaagttttcctggagctgtgcacaaatctaaaatacttgatccaactccctttcttttcctctttctttgtctttcccggcttcctggtatctttctttccctcccacctttcttctctctctcacttggggttagaactgaaggattacctgttaaacacgtttaaacatgcttttatgataatacagttcaaatgcttcccatatctacattataacctttattatactctctaatgtacttcagcattatgaaatacaacataacatacttcaacagggaacttgactttcaaatgtcactattagtacttactaaattgaaaggaaatgttctcctatcagcaagtaaacacgatacacttgaatattcatgccattgcaaccatgcactattcaaatcttctctgtcaaataattgtttacaatccttttttttttttttttttttttttgagatggactcttgctctgttgcccaggctggagtgcagtggcgtgatctcagctcactgcaacctccgcctcccaggttcaagcaattctcctgtctcagcccccctagtagctgggattacaagcgtgcaccaccacgcctggctaatttttgtatttttagtagagatggggtttcaccatgttagtcaggctgatcttgaactcctgacctcaggcaacccacctgccccagcctcccaaagtgctgggattataggagtgagccactgcacctggcctgtttacaattcttaattgcctgtcagtggtgtagatgtgtatgtatgtatggcggggtcacgggcattattaccaagtttaaaaggaaagagtctaaaaatagttcccatgactcaggaggaaagtgtccctgtgttgtcaccttatttccactttagatccgtctatgttcgtaaccctgggacaggatcaatgatctgtaaaccaggctcagcctccccctggtgagcctaatgaggcacagaaataaaatataaaagtaagttcaataccaaatcttataccctcctaagaaatagtaagagttggaaaaaataaatactcttttataaagagtgaaatgaatctgttttcttcatatctcccccacccctaacctttagtagaagccagcataaatctggggagagaagccctccatgagtgctgggccttccagcctctcacccacaggccatggtgtcactgtgactatagttttactaataatactatatggcggctcatttttctattcaaactctctggaagatattaaataagtctgttttatttaatagataaatcagggctgcgatgttctcaccaaccaattaagaagcccagggaaaatactgacactctccttctgaggttcctctgtgcctcctgaggatggcatatgtaaagttttctgtttccctggtcttttcatcccattcttatgcatcatatgagctttctagggttgtcatgacaatgtgccaccaactgggtggcttaaaacaacagacatttattgtctcatggttctggaagctacaggtctgagactgatgtgttaacgggaccacactgcctctgaaatctgcaagggcgatctccctgcctcttcctagattcattgggtttgctgacaattgttgacactcctcggcttgcagctgcggcacttcagtgtctcccttcattgtcacacagtgttctcccctcttctgtctgtgtcttcatctcctgtttgaataaggacacctagcttattgtattatgatccaccccggtgatctcatcttaacttcgttacatcttcaaagaccctatttccaagcaaggccacactcacaagtactagggggtagatctttaacatatcttttttggggaccagttcaacccataacactaagattgaaaacctggcaacatcgacttaaatatatttgagtgtgttagtgcaaacctggttttggtgccttttacattcaactggacattactggtgttatctcatacccctctttacagagttctgagttgtcttcgtgaattcttatttacaacatagatgcattagacacacacacaaaaactttattttgtttgaaaatccttgacctttggaatacatttaaagatgaaaagaactatgtagtcaactcaaatctctagagaccctgtagtcctcatccttttgttaaactttcctcatgactttgctacagtgggtagtcaggagaaagggctttcccctacctttaatcacaattgtctgtggacaacttttgtaatatatcccaatgttgtaggagtctcagcttgaccataaagaagatgctaatgggtatgttggacgaactgttggtgcagacccaccaggaactaagggatcttcctgtaagaagttcttgcaaggaaagatggaatttggcataatggacttctacagatatcaggctttggtcatgtaaaagctgaggagctgctgaacatctcaataagtttaatgtatctggtttgtctccaggcccttgggacagacgcatgaaatctgtggtagtcaggatgggtcacactgtactaacccaaaaaggttacagctattttataaacaccaagagatgcttgacaagacaataaaacatagaaagtactattatttgagtgccctcggtacttttctcacacctggccaagacctacactttgtagggccttttctagcttcctctagttatagccttctccagaggttaaaagttctacatagctaaggggctgtgtccaccaagcatctttgcccccaattctcgcacacactgttagaatccagaaatttccttccctaaagaacgtgatcccattatcaagaatctccaggtcccttccccaggttttttatcctgaagatagatggcacagccagtatgtgtagatcaggctcaaggggtgcctgaggggtggctattagtggggatggtgtgaatagagcttgggcatgcagactggagcatccatacacttatccaagaggctgctgggcacacaaggaaaatcctcaggtggaaagggaaacaggagtaggctagaggctggggttaggtactggaggctggctctcccaggtcactatgttccatcatgggacactgaggagtccaagaattccaaatatgaatgtggtctttcttgtaattatgaaggtaggcttgtcaaagagggaagatagtacatatattattgaacattttcttagcttgattcataactttgaagtacaagtgacccttgaaccacatgggtttgaactgcacaggtctgcttatccctggattttctcccacctctgccactcctgagacagcaacaccaacgcctcctcctcctctttctcttcctcctcctccacagcctactcaacatgaaaatgaaaaggattaaaactgttatgatgatccacttctacttaatggatagtaagtatatcttctcttccttatgactttcttaattttattttttctagtttactttattgggagaatatagtatatgatacatataacatataaaatacgtgtcaatcaaatgtttatatgattggtaaggcttctggtcaacagtaagttattagcagccaagcttttggggagtcaaaatttatttgcagatttttgatggtgagggagattggcacttctaacccccacattgttcaaaggtcaactgtaaaatcctaggttatgagggtctctacttgtactcttgccctacaaatgttaggggtgggtctgggtgcctgtccatcaaagtatatttccagaggccaggtgggagggaggcagtagctgcagatccaaggaagcacagagaaaaatagtagataagcagccaagatgagacagtggaagctcaatgaagttatgtcacttatctgtctgaaaccttaattctgccttgtcatggaaactggcatattcacaggttctggagataaggaaacagacattttggagggctgttattctctctgctacaggctttaatcacctgcaacttggttataaaaactcgtttagatgctttatcaggtagcagtgattcaaatgaattacactctgtagttaccttgaaaggaacccctgaaaaagggattgcagaagccaaccaatatagcaaagcacagacttcacgtcctagctttttgccttgacttctttatttggtcaaagaatctctctctctttctctctctccccgcaccccccaacccaccccatcactcctcttctcctctgcctttcctctccttctcttgcttaacaactgattcacactgtttaaataacttccgtgggtagagagaacttgaagtacaaaaactaaatagattttctaagtcacacaaaaaatctgagaaccaagatgcatgcatttgcttgcatcaacagataacggctaacttgcattgagtgtttctctgtctgagatactatactaagcacttgacatgtgttatcttattcactccttctaactgccttattcagtaggtgctataattattactatctcatttcacagatgaaaacactgaagcttgaagaggttaaagaacttgtccacaaccgtacacgtatcatgtggcgcagtcagtcctcaaacccagcctctatagttttgcactgagccccttcaccaccatgactgtatctaggaatccttgctaagcttccccagagatgtgaacaccttccataaacatgttatatacagcagacatgaccacagcttgttcaaatcagtagaacattttccaagagcctaacatgtattgggtcccgtgttcaatgctagggatacaaatataagtaacaaaatgcccatgcccttcagaacctcagcttcctggggaaaatggaaataggaaatgtcaacgcagcaagtgaagtgctatggtagaaggcattacagaagcccagcagaaggctgcaagcgatcaaggttgttaaggagaaaagaaacaggctaggaggggaggattaaaacatttgaggtggacgttaacagatgaatacaaataagccagatgaagagggtagggaaggtatttccagtcagggataagagcaacgtgaaggccgagcagtatgggaaggcacggcccatgcacagtgtcatgtacctatttacaccacacactactactctgaactctttgccataatacactctggaatgctgtatgccttagcttgaccttctctatttctataaaaagcgaaatcactcctccctctgatgacccatgtcaaggttgaaaaaccatctactgtatttcaaaattttctgagttgatttggccttaaggattctctaataagcctgatataattcttaacaattcccccccaaagtattgaactaatagctattccctgacgcaaagcaattttctcggaggaaatgatcttagaatttttctgcatagcgtggatgctttttttttttgacagaacactgatttctgaaaatgaatagaaagcagctgtatagctgagcttaaatgtagcccaatcatgtcatccgtgtgccagaacaagataatttttccaccctaattcccatcatcctctgcttgatttgaaagacacctacatatacttgactaagttctgggtgcttcaaaaatgtatactgtttcttcctaaaggaatatgaatttggaaggggaatcccttatcctaaagcaatcacactgaaaatatctcttgacatacatttagactttcaggaataaaatgaagattgatgtcacagtgaagtggttcaccagaatccagtaaaacttggggctaaggaaactttgcaatcaaaaaagcctatccagctcttcttgttcttagatgtccctcctcatttcttggccatgctaaacaaaatctcaactgttatctcaaatatctgaacagaggttattctgaacagacacccatgctgtagggcaagcaggcccttacaggccttgcactctttatcgtggccttgtagatctttgcttaatttgctttagtaaatattctaaatactgaccctcaaagtaggagacttttcctagagtttctcctgtggagggggaaagtcataaagctaattttggcaatttgaaaacaaaattttcatcactatcaacgaagaatatagcaaattttaataatatgacactgtgtcatttgaccacctgttaactctagatggcaaatatatttaaatgattctactttcatagatcttacttagcaataaggtgctcactattatcatcgtaagatttttggtgcaaaaagtatatactagacatctgatatggtttggctgtgtccccacccaaatctcatcttgaattgtagctcccgtaattcccacatgttgtgggagaagcccggtgggagataactgaatcaaggggggcagtttctcccaaactgttctcatggtagtgaataagtctcacaagatctgatgattttaaaaggggttttctttttgcttcgttctcattctttcttgtccgctaccatgtaagacatgtctttcaccttctgccgtgattgtgaggcctcctcagccatgtggaactagagtcccttaaacctctttttctttataaattatccagtctcgggtacgtctttatcagcagtgtaagaatgcactaatataacatctattcttctgtggtcagaagcgctctatgacctatgggtgtcacacccaataaatatgcatgaattaatggcctgacagtaataaaataagtagaatagagtccttgatctcactagatttatgatgaagttaaggaaagaacatataacactgagaattcataaacaaccccagaacagtattaaagacaactacgtgttaaactatgatagttcagcagaggagaagaccagtgtgcaacagaagagtcagagggagctacactgagagatggctttgtccaaaatgcaaatctcataacacagaaggcagccaaactcctgcgtacctccttcctcctcagacagactttaaatactttaaaggctggagtttcccagggtttgattctcatttctcttttcatctccatctccactgtctcctcaggtgatgttatccagctccatggagctcatagaatgaatgattctcagttaatgtcatggatactaatctcccatttgagcacctgatataaagatccaaccacttacttgacaactcaacttccatatgtaataggtaattcaaacgtataacatgtccaaaatagaacttttataccctacttcctgacctgctacttcctcaatcaaccacacatctattaagagtgccaatattcactcaggtgcttggaccaaatcccaagaatcaaccttgactcttctattttctttcttgcccatatctgatttgtcagcaaatccaatcatgtcttatcctttccactgtttccacctttgtataagccaacatcctctttctcctgaccaacaagtagagttatcttcctaaaacttatatcactactctacttaaaacactccagtggtcttccagtggtttttcaatgctaatggaataaaatccaaactttctaactatggtctgaaagaccccagtctagtaaatcaagaactattaatcatgcagtttggtaaatcatgacaacattaaaaaaatagagtggaataaaaatgccacagtgcaccatatgtagtaagggaaagtattttgtgatgctttttaattttaaatattaaggtataaaagataggaaaaaccaacaccactcaacacaggactactgacaccagattctccagcagacatcagttggatgtcctttcaattcggacactatctacccggtggtagcctcagatcccacaggttaacggctcagcccacaagactgcctcccaattctgatggtaatcacaagcatcaggttgtgacttgggcttctgactaatgggctataaattggagttcctacaacattcttcttaggtttgattaacttgctagcacagctcacagaattcagggaaacactttcacttatggtcattcattattataaaggatattacaaaggatacagatgaacagcctgaggtaagagatgcatagggtgacacagaattcagggaaacactttcacttatggtcatttattataaaggatattacaaaggatacagatgaacagcctgaggtaagagatgcatagggtgagacaggcaggaaggggcatggagcttccgtggcctccccaagcatgccaccatccagaaacctctgcatattcagctatccaggagctacccaatcattttggatttttatggaggcatcattacatgggcttgattgattacatcccccataagtggggagtggagatgaaagttctaactctttaattacttcttcagtttccctggaaaccagcccccatcctgaggctacccaggagcccccagccaccagtcatttcctttgcatacaaaaagacacttgtcactttggagattccaagagttttaggagctatgtgctagaaaacaagaggaatgccaaatgtatttatcttattataaatcaccatattaagttaggctatgtgtgtatttgtttgcaacacaaaacatttttcttaatatgagttacattcaaaaaatgtttgcaagcccctgacctgtatgatctggcccatgactacctctctgatcttttctaaaaccacactataccttgttcactgtgctacaacctcactaacattcactctagccctcaggcaggcaagctcacccctgcctcaggacctttgcatacattattctctctacttggaataatttatccttagacattttgtatgtatgcttctttcttaccattcatatctcaattcaagtattacctcctgctaggcatcttatctctaaagtaacaccttccgtactgttcatctcaccacagctatcttatcaccctgtttcagcttcttcttagcactgtacccatctcatctcattcatttacgtttttgtgtgtgcctttattttctacgtatttctcttagaatgtaaacctccacgagttcagggaccacatttctctggtttactactctatctttagtgcaaagaataatgtttatcacacaacaggtgctcagtaagtatttgttgaatgaataaagaaaactgaagacataattcccctctgttaaggtataatgggaaacctttggtctctcctgggcttctcagggccccgtgtagaaaagtcaaggctgtagaattagtattcaaaactcctccctttggctttgtgttcagtccaagagaccattcatttcagcacattaaactgttaattatggagtctggcttctcctttctttatgtggaaagaataaatagttattactaaatagtcatttaataggcagtggtttctttcagggcaaccattattaaaattgcacaaacatgtacataaataaagccatttacttaaaattaggacagactgacttaatggattccacttttcttactgtcctgggtactacctgcttggaatacacagtccttttttgtccttcctctcactttatttcctagctcttgccaatatgtacaccgttgatatatgactatttattcatggtaatttatttccaagactttttttttttctggggttactgatttagttaatagtatttaaaacacaaagtaattttttttggctggggagagatagccaaattgataattttatattatgtatgtcgtatgagtatggctttccctgaattttcactgcagatagacagacagaacattggtaagaaataggaacaccagactagaagtcagttatttaacgttccagtcccacctctcaccttaaccagctgaaatatttggataagtcatttaaattccctgagccttgggtttctcatttgtacaataagagggccagtttaggctttaaaaattcctgttatgtattcagacttattacattcaaagaactattataaattatcagttaatctttgcaaaaaacttacaaagtcggtactattatttctcctattttacatatgaggagaatgaggcagagagaataaataatacacattttaagtggtggagatggtttgaatctaggtagtctaaagccagaattcaaactcttattcttcttactgtaggatctctgttcctatttatctctgagagttaaatttatagctgggcatggtggctcatgtctgtaatcccagcactttgggaggccgaggtgggtggatcccttgaggtcaggagttcgagaccagcctaatatggtgaaaccccgtctctactaaaaatacaaagaaattagctaggcacagtggcatgcgcctgtagtcccagctacagtgagccgggatcacaccgctgcactccagcctgggcgacaaagcgagactctatctcaaaaatagtaataataatttaaaaaagagttaaatttataggttgtgaatccttggatctcatgttgttatagtaggtagatagtcaggcatgagtaggggaggtgaggcttcccctcatcccactaggaatgtcaggcaaccatcaggtgatggtcatgcagttgtcacgctgcctctctaaaataataattggtcgcagccagcaccaggaaaggcaggttccatatagatagaaaaagcacctgaaactggttatcatcagtctcctgatgagatctcaggatttgggcaaatgggctcaaacatgtgcattaagaggcaaaatggcagagtttcactggtatgtccatctgggggcgttccaccagtaaagggaagaatgagtcaggtgagcataagtacaactctagtaaacacactgcccatgctcacctcccaagtgctagcaggccattgtgtatgtgcgcagctcaccccaagggaagaagcaagggaaaagggatgtaagacaccagaaacatgccagcatagaaaaccctaagtccaaggtcaaatagggcacttgtcctctgagatgccctcttggccctcttccaagggtactttgctttctttgaattcatttgctttatttgaattctttcttctgaagagggaagaatcgaggttgctgaaaacccgtaaggattcacagccggtaacttgggtacccgccacagctaacatattttgttgccatgtgactccaataacttcaacctatagcaatgttagcttgtctgtatcttatttcaccagcaggctggaaactacttaagtgtaaagacgatgttcatctttgaataacctgagacaattagctccaggccttgcatgcagtaggcattcaatatttacttttaaaatgatgaggagttgggatggattcatgcaacaattttgacattaaccaggtgaaatctaaggtcctttctgagagtgtgtgattcaggcattgactgaatactcttcttgaaggagttggctgtgtctgcacagattcacctctgatttgctcctcaacttaatgcaatctggttttcagccccactgatgccactgaatctctgcttgccaaagtcaacaacacacttcgaaaggcatttcttgtcctaacctattgcatctcctgagaacatctaatattgttaactatcccctcttccttaaagcgctcatttcccttgaactggataacacagtgctgctgacttctctccatccacctctcagggtgctatgctttgtcttcattttaggatctgctttccttacctagatctacaatgttgggatctcccaagggtctgtcactggtccttctcttctcgctttccacactatactccttgggctttcccacacatatgctaaggatttttgaatctatagctccagcccagatctttctgttgagcttcagacttggtatagtggtaaaaagtgataacttactttaaaatacttccatatgaacagtatatatatgtagagtatattagtcagcatttgaaatatctaaatctggaatccacactctaggaatggataggaatttgcagtacctaatcagggatccatattcagagatggcttcaaaactgcttcatactgtgttaatagtctctcccagaaggccaaattagacagcaattttagacataatttttcgtttgtggatgagtgatacatgaactatatgtttggctataggaagggggtgtaaagacccaggaagcccagcagcctatgcctttgaagcaccactcagcgcctggcttcctgattctgtgtctctctcttcacaaagaactctgctacctgtggttgattggtcccaccacacgcaaagctcaaggctcactgtatcttgaacatctattggatagcaccttacacatcaagttcaacaggtccaaaatggaactgatcctctttgcacaaaattgatcctccttctatgttcttttatacagtaaatggatctacactcactcaatgggccaagccagaaatctggacattagtcttaacttctcccattctcatcatatccacagtcagtcaattaccaaattccatcaacatcatcacctaagtcattctcaaattcacccatttctctcccactccacaggcacctcccaaacctagggcaccagttcctctctcctgtccccagctggaccccttctactctattctttatacatcagccagagtgactcaggaaatggaaatctgtagtttaattaatatattgtagttacttataggaaaaaaaaggctgatagagaaaatatctaacaactattaaatagtataggtagcaacaagtcaaaagaaatgccaaaccacttacagtgaaaaatagttagaaaacaacacgttaaacaagccaggttattgctgcaattatcctaactttgttatgttgtagattgggcatatcactgttaacctttgtttcctctatgccaagtaatgcttgacagacagcaggctcttactgaaaaaaatgaaagaacatgaatgggaaaacattcaatcaatcaaccttttttttctccccccaacttccactcccagttttcctcttaaggaaggagtatgcctcaaaccaagaaactgagaagtttccctaaatcctattgattggtaccctggacttggaagcaactgacttcttgattttctaccagggtttagttaactccacatagtatactctatgagacgtatcattgctataaggttaatgatagttatagggcccagtcaaacatctcacagggcctatattctgtgtcacttagcagtatgatgcatcttggcccagggatttgcaaccttggcctgggaatttccaggagacaagactacctcagcacagatgcagttctcataaaccttaaaacaaagcttagcgttacaagaatagcttaaactccctttgtgaaagaaacaccttgtaactgacccagaaggaatacaggtataaggaaaggggaagaatccccaaaactctaagaatggtctctggatggaaactctcctggtcaatgggtcacctgcccctcaggctgtgccaggcccatgccaccacctgctcccgctacctgtcttttaagggttctgccagaataaactgcgtgagcatcagatgctgcctaagactcagctttgatgggaatcaaaccaatggaaagaagtttcccctagaaaagctggttacctagagtcacccaagacccccaagactgacagtccagctcaacaaatgttcattgacaatctttagcaattataatgatgaatgagtcataccctctttctcttgtaaaggtcactgtattttggtggaaataaacatgcgtttgagtcatttaagtaaataaatgttgaagctgtgttatccaacaggcagagtaaactcatatttaggatatcagcatagcaggacactgaggacatcaagaaaaatttagaagagttcgacagaattgatataaaaaaccaaagcaatcaccaatggacaagttcagagctttacgatctccttacccttatgttataatttaatatgatttttattatgtggggttacacaatagtttggtctccccaataaaagggacctcttaaatcttaatctattcctaataagtgctaaaatagatacataaatagggtgcttgggagcacgcaggaggacaattaaataggctaaggcaggggagagtagggaacaggcgaggagaaggcagcgtcaaaaggagggatgcctgagctaagtctaaaggggcaaattaaccaggtgaaggtttgggaagctaggagaggtatactgttcctctggtgggacccactcacccctctgagctagacctcccaatacttcctgctagcctagaccatcatctgttagctccctattatctattacatctgccccattgaaccttgactctgtgaaattctgagtctgtacctcccaagaggtctacctagctgcaagctccatgcttggtcgtatctcaacactcaagaatcacaacatatttattccattccaataaggctaatttgctcatggtttctatttttgtttttccttcagtgatcacctacacttctgttagtcattaaacaaatggcagctggcatcatcgccaactttcaaaaccttattcaaaagtgatcttctataggaaatctttcgagtggttagatacccacatggaaagggcttccttctcatgaaaagcaaccaatgcactttgtttagcattgtgtattcataaatatttatccattaaaaacaggcatctgtatggcaagtcccacaaggatgatttaaccaagactgcaaactcctcagctgaccacatcccatctctctttgcttcacatcatcctgctagcccctcaaatgcttggccggccaacaaccatactgtacagtcaaaaagattcatcaagtcctcacttagtttttattcaaccttattccatcacaatttctcaccaacatcagattaccggtgaaaatttgatcagagagactgaggtaagagagactcaaattatttaaatctctcaatggaagttaatagttttgaagaattagagcatttcatatgggagcaatgtcaaaataggtgacctagaactgaagtagttttccccagactctgcagttactgaattgactccccaggctgctcatattttccggctatttctgaaaagaaaaatatacaaatgcaatacccctttttttccccaaaggtctttgcttccctataaatactaaagtgtgctccttaacccacttatcctgtgagatgcctaaaaatggcctcttggatgaaataacttcaggaaacaccgtagagtatagccctggtttgaaaattcactatgaacactaacgtgttaaagaccctattacttctgtaaatagcctagttttacttcgttaactcttcctttcacaagtgtatttgggcacagatcaagtttccccttcccgcaatattatcaacaccactccatacaaaggagagttggaaacagccatgttactcctccactgaattcacacacacacggatataagtcttgtgtagtctgaggtgttcatttcaaccctggatagtaattcaaagtagcaaacagctttttgatgtttgctttgtttggttgcagaaaataagctcagggtagacagttcttcaatgacagttctttacttgcataaagctagtatggattatcccaacttttataatgacagtagttaccactgggatgcaaaagaagcaaaaagaaaaataggagttctaaggggcaggagtattagcattgcactataatgctgcagtctaagcaggcattccattactgggtcgatggtgaatacgaagtggaggttcaatcactacacacacttactcaatagtctcctctaaaaaaggcagtaaatgtcttgtttttggctcagatgaaggcctatcaaccgtcagaagtgcaggcttccacacagagattcagagcagcactacagccgctcagcatgtgaatcccaagaggcaggtgatttagtcaataggccccagagcagctattttaaacacagggcctgttctctttaaaggtacaggatttatttatttgtgggccatttaaaatttcctgctttcaccggcttttgatctggactcaggtattatatcttgtcctattttccaacatgtaacaattccttacaattataatattcacccatccatccatttggctaacattattgacaacctattatgtaccaagcactgctctgttttttttttattgcatgtaaaaatgatggtgatattataatgaatgaaataagcatttgtttttgcaatccaagtaaaatttacctgtattgaagaatgtagaggatcttgtcaggaaactaacgacactgccacatgaaggaaatcaaataaagccgggcgcggtggctcacgcctgtaatcccagcactttgggaggccaaggtgggcggatcacctgaggctgggagttcgagaccagtctgaccaacatggagaaaccccctctctactaaaaatacaaaattagccgggcatggtggcacatgcctgtaatcccagctacgagggaggctgaggcaggagaatcgcttgaacctgggaggtggaggttgtggtgagccaagatcatgccattgcactccagcctgggcaacaagagtgaaactcagtttcaaaaaaaaaaaaaaaaaaaaaatcaaataagagaaaggtgctgtgctttttgtaggtcagtgtttttcacaagacaccgatattgaaatccctggaagtacctatttaaaatgcagattctgctgggtgtggcagctcccatcggtaatcccagcactttgggaggccgaggtgggaggattgcttgagcccaggaattggagaacagcctgggcaagatagagagacccagtctctaccaaaaaaaaaaaaaaaaaaatcagccaggcatgctcacacctgcagtcccagctacacaggaggttgaagtgggaggatctgcttgagccagggaggtcaaggctgtagtggttgcaccactgcattcatacctggcaacagagcaagaccctgactcaaaaacaacaacaacaaaaaataccaaacatttggccaggtgaggtggctcatgcctgtaatcccagcactttgggaggccaaggcagtaggatggcttgaacccagaagttccagaccagtcgggcaacataagacctcatttaaaaaaaaaagagacaaagaaagaaaaaaaagtcagaatccaggaatctggatttttagcagtactctggatgttctttgtgcatccgtagtgccatatccatccctgtcatgaaggaggagaaaagaggcacacattctctccaatagaaacacctccacattcatgtcttttatttattgggtttcctgtatgacgtcttcaaaaaaaaaggatgcaagaaaaatatcacttcttttaagtgtagcacattagaaagtcacacctatgagactctttagctgcctcatcattgtattttaaatgtggcctcacagagaaaccatggattttagaatcgggaagatacacctccaccacttattagttatgtaaatttaacaagctaatttgtctgtgtgagtcttgattttctcagctataaaatggggacaatagcaaaaaataatgataagataatcagattaaaagatatatcatagagatatatatatattatcttttaatatatattaaaagatatattaaaagatatatctgtaatagagatattacagatatattatagatatagatataatagatatatgacagatatattatagacaaacacctggcaaatgagtgggcttacactgggtactccccaaaatttacccccaccccttccaaattctgccaaattttatagagtagctatataaaaattatttttatgtgttttcttaaatgctcttcttaagacattggcccttatgttgtaggaaacacctcgatgccaggttgaagttcaatacttacgttaacacattatctttctattttatatcaatgggagttatttaaaccaccatatttcttttcagcttaaattatcagaaaatttagatgtgaaattaatgctcaaaataaaaaagtgtttctcctctctatattacttatggttattcttaaaaacaaatcacccatttacttattcaacaaatcattttggccatccaataaatttattgagagggtatatcctcaagaggaagagctaagtcttatgcctgcatgtaatacactttatttattaactgagtgatgatggacaagctatttcttagcctcaaactcctcaaatgttaaattaggctaataatagtatctcgcaagattgttgcggggattacataaatcatgtacttagaacaatacctggcatttggcatgcactatagcaatgttatttagtattatttaccaaagaatagttactgaagatacacagtaaaaaagcatcttaaaaaggtaaaaagagtatataaacttacctaagtggaagttaagtgtagcataaagtatatcttataaatgaataatggagtaaatgaaattcttattcatctcatctaatgcaagaaaactcaactaccaacattatggaattttgatttgatatcactcctaactctattttcactctccctgaaggtgttcctcattttccctccttgagtctgtctatatgcaagaatggatgagcaatcagaaatgtgtgctcactgatatgtggatatagacctctgaagcatctaccccattctaagatggtccctgctcaaagggatcatgctgaagaaaggtgacccttccagctcaggtttgctctgatctccgtagcataagcaacacaaataaagaaactatagtcataggactttcgttaaatgcttagttgaagatctcaatttctgtttgcttctccttagccatattccaagttcattaccattaaaaataaaacaacatgtaatcttaatatatacaattagcaacactgtgtgctcaacgtgtctttcttaagttcttgcagacttctttcttttctcctaagaaaccccatctctttagatgagcccaactattcacactctttcctctcgctcctcaaattataatcaccgtcacatcaaagacccactaaaaggcactcactgaagcttttaaattaaggtacttgaatgacttagaaataggaatcacaaaacaaatctatttacatgcatttgtgcagaacattcctaaatgttcaggtgacactgacctactaggccctttagctcgctatgtgaggaaataagatagaatcttcaaagaagtttggttgtcaagaagcctctgggaccagtgaaacaaataattaacttatagtggaaagagaggacaagaaatgtttccctctgggcctgaaatacagtgtgctctactttgcataagttaacatcgggaggtttgaattttccaaagggcttagtggctaattagctgtgtgaagttgcccatagtgtgtccttaagactaaacattcccatttctcataaaaagctgtaatagttacatgaagcaaaagaaattatctctactatgtgtttggggtttgtctttcttgtggcctcctttttacttctattacaacacttacgacacagtactatgaagatcaactctctcttccccactacaatggaagctttcgaagtataaggattgtgtctgacttaactctgtattccatgctcctagcttgacatttagtaggctctgtattccatgctcctagcctgacatttagtaggctctgtattccatgatcctagcttgacatgtagtaggcattcaatcaataatcagtgtttttcagataagtgggctagtatgaagaccaccgagagctatccttccagggctttaaacacctctatactcagctagtagaacattcaagtaaaatacagaaacctactgaataatgagatttttttttttttgagatggagtctcaatctgttgcccaggctggaatgcactggcacgatctcggctcactgcaacctctgcctcccgtgttccagtgattctcctgcctcagcctcctgactagctgggactacaggtgtgtgccaccccagctaattttttatttttaatagagatggggtttcaccatgttggccaggctggtctcgaactcctgacctcaggtgatccacctgcctcggcctcccaaagtgctgggattacaggcatgagccactgcacccggcctacaatgagatattttctaagaataatacctgcaagtagattaattattataggcataattttaatcagaacaataaaaatttatgttttctaactagtttcgggcctaatagtttagatgcataaggaattgctcccatctgaatgtagacagagagtatgtgatgggctgagtccaagaaaatgaaaccataaaaccaaagtcctacatttaaaattttaaaaagcagcaagacagaatggaagacagcgactgaaacacatgagttttcctgctgaccacaagcaccctagcagtcagaagtgggatgaaagctaataacacaatactcagctgcattaattcagtgggtcagtatttttatcagagagagtaaactttactttgcttttgggttctatccataaattgtgtgtgtgtgtgtatatatatatatatatataaaatattgtgtatatataatattacgtgtataatcatgttttaaagacctatatttagttgcactaaataatcaaagctaaggaaatctggatcttgtgaatttcctctagcttcttctccttattctgctctatgatagctcacaaccatagctaaaacatcctgagcatcttctatcagcagtcaggtactacagtaatacattacctatattcactcatttaagatttacaacaactattattactctctttactgcagatgaggaaacagaagcaccataaaactggggaaccagtccaaggtcaaaaagtttatgagtggaggagctgagcttgatcaagggagtgtggcatctgagtctgaatcctgatccctgtctcacatcatcttttctcgagacagacttggaaatggaagacagagggaagcagtgtagtttattttagtcttggtgagtgggagaaagatgtttaaaatatggatgcagcttagacgttgatatagtttggatgttgtccctgcccaaatctcatgatgaaatgtgctctccagtgttggaggcggggcctgttgggaggtgaccggatcatgagggtggatttctcgtgagtggcttagtatcatccccttggtactgttgttgcaataggaagggagttctcatgagatttggttgtttgtttaaaagtgtgtagcacctccccctcctcttgctcctgcttttcacctgtgtgtgtctgttccccttttgccttctgccatgactggaagctccctgaagactccccagaagcagatgcctccatgcttcctctacagcctgcagaaccgtgagccaattaaatctcttttctttacaaattactcagtctcaggtatttctttacagcaagaatgtcctatagagatgtggatacttttttcccccaatcttggccactatcatgtcctttaagttatcagagatatataggtgtgttttcaaaccagtagtgtatttttgtataaataagaaattagcaattgattctcacttattccatttctccagagatacaatgctgacacatcccgaatttaaaagcattttaccacctagtggtgggtaccttgagaaactgccagatactccaatagctcagagcaataaagaagaacgggggaaaatttgctaacataaattttaagtggaaccatttacatcttggtaaatcttccctatatgtcaataaaagaaaaataaaagcattatattaataataatcataatgagaagaaattatacagtgatatcaatttccttggggagggtggatagtagtataacacgcttctcatttatttaatttttcatatgtggctttttgtactactgaaatggtaaaccatccatgagggtgtggctgaaagggatgtttagtttatgtacaaaaatgcaggagaagcacacccctagtccttcactgacatatttccgaaacatcagaaaatattctaatcaaaaccgctgttgattggaacaggataatagaaaattcaattgaaacaaaagtaaatgaaagaagaaaaacaatcggagtctctattaaagaagaatttatatgtcatgaattccttctattttactgggtaccttatttgatcatttaatacttgcaacaatgttgtgagaaaggtattggtatcctcattttactgatgagaaaattgggtttcagatactgtaggtgctcaatgtcacacacaagttaggcaggtttcaaagaggttcagatgacaaagcctctgcctaggatgacacctcatctaagaaggacagcagtcacctgctcacagggaggtgatccacacttgtgctctgatgccaagtgtcaggtggacagaggtgaagagacataacatctggaaacatgagtagaagaaagctcaccaggagcagcagagctggttattttcgtgaaagataaattgatgggttgcttgctgatagcttgcagtgctattccagataggctggtaacccaaataacttgtggaattctccacagctgaggagaaatggaaaaaaaaaaaaaaaagcactagccaagaagtcattcgattatgctaaacaaaatcaattcatttatgacttttcactttcgtaaggtggggaatgagtggtttcttaacgttcatccagcaattgttttctagcctcattgcacgactgctttttaagttcaccttgacctaaaggcaaccttacaaaatgctttgcaaagttgtggaaatgttgcattccacatggttgtgaatagaaagagcttcttgaggccttgattagagctgggtggagctaagcctgaaacagatgatggctacactacactgcaggcccagctgccctgcccatgggcacaacagcaaacccagagacagtgcagggaggctgggaatgggtcaagtttaaattaggcacaggatttggcaagccactacataaaaatacaacagcccaacagaaggccacgtttgggtagccagccgtcgtcaagtgcaatgtgggaggcgccctgtctggaagagaaaatgggaaagaatccaccataagaacatgactcaaagaggtcagtgatgggcataaaaatatgtccattgcttctcagaaatcttgccaagaggactggatttctaataccagcaagcaccaagaaacagaataagaagaactagattgtcctcctttttctgatgtttactaaacctctattttctaactatattggtggcaggtagcattttctataaaaacctagctttctctggtacttttactttttttctgcctctatagaaatttcaccttagtttatagctggaggaacatactcttcatttaattttcctatctgccttgctgggcaggtggttttggactgaactgattacattttaggtaacaggatatttctcagagacagcatgtcttgctgggtattttgggattcatggaaaataaaaagaaaaaatgaaaagaaatccattcacctttcatggcagtgatttagtagacattctgtggtctctattaggaactgacccgaatagaaagctagattagcctaaaaaaataaaaaaatgtagaatctggtttacaaaactccttagtttctgtttttatgccttagagaacatgtatgagttcaaatataattacaaataagtaaaaatatgtcaggcctatgtttaagtgttttttttttttttgtatttactagcagtgatgtttttgtcaaaacatttttattctctgatctttagtcactttactgtaaaatgaagatgaagtcagctctgcttatctcacaagtcttttgaaagactccaataaaacactgtgtagaatcttcgttaagccttaggtgttcagttaattttaaggtataattttactatctctacaaaaaaatttaaaaaaaattagctgggcatggtggtatgtgcctgtagacccagctacttgggaggctgagatgggaggatcccttgggcccaggagttcaaggctgtagtgagctatgatcacactattgcactccagcctgacagatgacagagtgagaccctgtcaaaaaaaaaaaaaaaaaaaaacaagaaagaaagaagaggaaagaatatactatgtgatagttgttaattagaattttattttgtcttattgaaaaatttcttctcactttgaaatttactagagtaagttggaattattagtttttcagaaacagagagagctggaaagccatctttatgacatccctcattacagaccaaccaccaagtgatctaactggtacatataccttgaaagacatctgataaacacagagcacacctgatgagttaagccaggtggaggtaaaagctacatttttcattaaaataccacagtgctggaaatttctaaaagaccttgagtggtgatagttgtaggggatgccctggccaaagtggcctgtggcgttgcatgctcccacaaaagccatgtaggcaagactcaatggcgttggaaccgtgtctgggcagaatgctctgttttcctttctggaacatggcatgatgagcaagctatccacggctgtcgcaggccatttcacatccacctccctatcttgcaggaggctctgtgtcctgccgaaggttgtcatgaggctctttcccatcaacctacctggtaccagtgaggcatggaattttccccctcgcccttcttggatacagctgcggaccgtaaaaccattcagctctagtatgaaattgacttctcaactacagagtggctcactccctgtgatgcgtgttttccggtccctccaggttgatggtgtcctgtggggacagggatgagaccctgaagaagtatatgctgggttactgaagctgaatcaatgcttttctccaggtgtgtgtatttatgcacctgtcttttctcgaggggactccctaagctcccagccaggtaatatgcacacgatagcaccagaggcaggatggagaaaggaggtcaagctctccaagttcagtaatataggcatgtatttacatgccttttctatcccaggtcttgccactgtctggtgttctcaagtcaggagcttctcagtattttcaaataataaacctctgtggcctccctgggaggctgcatggagtaggggaagaccctggagatctagcttcctctagatccattcttacaataaatccatctctttccagccctgttcctcaatctcatttctcatggtgctgagttccatggggcaaactggttcattaatcacaggtatctccatgttgagagctgggttgtagctctatcctttctgctaaggcaattactgctcttccatcacttcccttcctttattccaaaaaaaaccccacatctttcattcattatttccttctgtcctgttctccttgtccttgtggattaccacctttcgaacatttctttattgcagcttctattggtttggggaagaacgggagactaactctactggccagttttccatctgtaatgataaattcccagcacaggtgggtggaatatgcatccttcttgtattcttagtgcatttcacagaacctgactacagaaggtgctcaaaaaaaaatcagtattgaagaggtggctacatacaacaaatgtacactttggctacaaagttagataaactagcttgttcagcaaacattttcagagtatagtattctatactaggacccttgacactggatgccagggcagataaaacacaattcttattctttattgtcagtaatgtggtgaaagtcccttggaatcgggtgaatctgcaaaatttcagtgggaacaagagcatgcaccacccaggcttatgtcctagtctttccagggtctgggagtaagaaaaagatacagaaacctgattacagtcatacagttaataagttaacagacaacaccctgtggaattaattcacctttcaatattcattataaatgccgtcttccttctttgaatctctgcaattgtggcaagccaagtttatgccgtaccttagcgataaaagtagagatgattaactgtctttctgtctttgtctcttcgttcctttttttttttttttgatagagtcttgctttgttgcccaggctggagtgcagtggcacgatctcagctcaccgtaacctccgcctcccaggttcaagtgattctcgtgcctcagactctcgagtagctgagattacaggcatgtgccaccaggcctggctaatttttgtatttttagtagagatggggttttgccatgttggccaggctggcaaactcctgacctgaagtgacccacccatctcagcccctcaaagtgctgggattacaggcttgagccatcatgccctcctgtctcttagtttgttttaattttaagaggaacaatggtgctttgttttggtttatgccacccaaagaaatagaagtatgcaactttaaaagaaaattttcagccaagggtaaaaacataaaaataaaaataaccaaattggtgtcagatgcaaagaatcccttgaaaattggtgaggattgaggaatagagaaggatactgaagagggatctattattcaaaactcaattaccagaaacccaagttaaactaaaggaagtgggaatttaatgtctcagtagctgcaaagcttcaggtacagctggagccaggtattcaaacgcaattgttaggttcttccctcttctgtactggcttcacgttcagacagatttcattctcgtgtttacacctaacagcttagcaatcagtgcagaaatattctctttccccaacagttctagcgaaagtactggccacaagtctctgacttgccaaacctgagtcacattcctcctcctcaccctcactccagaggactgggttgccctgctcaaaccatatgaaccgagagtcaggtcaggttgttacacaaaggaaatccaaggaaatgttgccaggaaaaggggagaaggcttttaagccagtatatgcggtagctacaattagtgtaagataatactggccctggagttttggctgcatcaccacttaaaaaaaaatttaagttttgaattaagccaaattgcttagcacagaaggctggtttggagtgtagctatttttgaattatttactgagcttcccactgcatttgccccccacaactcttagcatccatctcttgctaaaaggccacctgaccagaatgttaagagaaatatccaatagcctctacagaaagagtagaatatttatttttagctttatgatatttgttcttaaatgcttttcagcctggaatgacttcaatgagatttgtacatttaaaggctgccaaaaaaagaagggggaaaagtcgaatattaaagaaaatctcactcacatccaaaagtggaagattctttaaacttttaaagaaaatgttagttctatttttaactcacttttgggttgtctaaggcttaagactaacataagaagaaataggtcgagcaacaaaaacttgaaaaccaaaagattttatacttgggaattaaccttttattaaccctaaccctaacccccttttgacgaggagaaaaagagagagaaaggagacccttctatgtgcaattcagggttcagtcatctcagaattttccatatacaggccctagatcaggggtgtccagtattttggcttccctgagccacattggaagaagaagaattgtcttgggccatacataaatcacactaacactaacgatacctgataagaaaaaaaaatgcaaaaacgtctcatcatgttttaagaaagtttacaaatgtgtgttgggccacattcaaagtcattctgggccacatgcagcctgtgggccatgggttggacaagcttgccctagatgatttttctaaaaggaaatttgttctgaaagacagtagtcagtatacctttacacaatttcatgaagatgtctgggttatgagaattgtcctactaggaagagctaccaaaatagctcatcaccttgaggtactgtggagtgaaagtgaccaggtgctttacatcaagtttacaccaagctttactttccaaactttttaaactgtcagtacaactccttttgaacatatcttctaggttggctcttggagtgatacatccatcaccccattctactccaaattcatttgaaattggcaattttcaggttccaacttgcgatggcttaacactccaggcctccctaagatggcactgaacatagggcagccctcctggaggaccccacagagaggccatggagcatgagagtgagctgtacctggcatgatgtatgcaacgtggcttattctctttgattcaggttttacgtttctcgaatggagcctcttctaggttgctatccatttacctccccatctctctctctctttgccttttcctggttgagtccttcccgggttaacccagccctcctgatggcttcccttcactttgaaatccacagacaggaacaactctacatttaatgataaactgtcttacattcctccctaattagttcaaattgaaagtttgctctcacatttggaattttagtatggctatgataaatacttgtgggctcctcactcggagcaatctctgaacagacgatctgaagctagatatacaacattctcatatagtgttcagtgtgaatcaatatcaaagtttaaattcccagtgatattaatgaaagaggtgagaatttgttgctcatatcaataagaattagacctaaaatcacactagtgatctttggacttaatttagtgttcattcatttagatacaaactgagtgtatagtttctgtttaaaggaagagtattttgtccgtgatcaccggtgcacccaatggccaattgatttctgtttacattctgataattctttgcttatcagatcatttcacatgagaatcaagccctctgcaataagcagtgggaaaaattttagtcggtgagaaactccaacgcctcaaaagaaagagtgtaactttcaaaactgtcatttttgttctcatggtaaaaatctgactttgtgtcaatcattccccaaatcttcagttgaggaaagaggtcatgctctacattaattacagatgacaagctagagacaaaactaaaagtccaaccttataacttcgcttttctgcctctccctggtcaaaacaaaccctcttataccaactattcttttttatcacttgagtgctatgtacagggtaaaagtaggattacctcagaataataatttcacacataatttttgtaagaaaagggttcatgataatacttttaaaaataaacagctagcccaaatattcctccataacaaaatgtgacaaaaggaagttagaacaaaatcttaatttacacagaaagtaaaactgtttccctgtaaacaagctgggctgtcatgaaaatggataagggttcacagaaatttgacccaaagaataaagaatgaacggatgacacaaaaatggctaactggataaaaatatgttctgtgtgattaataataagtctccaaatcacagtacttggagagaagggatgggcatactactgtggaattctggatgtgtcaagatctggcctgggttctgggaacactggatctctttgttcctctctctgctgttcagggacagtggaaggggaggaaaaagggatcgtggtccagtgtacgtggctcagggactgggcctctggaagccacagggaccagcgatagtcacacttcttcagccctccagcgattgctctctgtttctgttctgttttcacactgttatccttcagcacagctctgtgcgctgtttgcctctcctccactggtggctgctctctgctaaataagcatgccacttgttcactgggtaaagtgaaaaagacgttgcttgtaaaataattgagtctccaaaaaaagaaaaagaaagcgtctggatcactatccgtgtcacccctaccctgagaagtctcttaccggggtgacttttcttcaaagaaagcattttccaaactaagtgcagaatgaagcaaaaaacaggaaagaactcagattattttatgacgtcacatgatgctgaattacagggtggaaagaaacagaaacacagaccactgacttattggagagagagagatatatataccatgtatacgtaatattatatgtcatataaaatatatttaattacatataatatatatttatagatctccatggcctgtgcttctatggaatcaaattgttgtgtatgcatctatgggcatatacagaaatattatatattaatatataaataatatatatgttgtttagatggagagagatcagaggagcactgaccatggaaatatagataatatacaatatatataaaaacatataacatatttttcctgtgatatgtgcttctggtctctgtgtgtgtgtgtgtgtgtgtgtgtgtgtgtgtgtgtgtgtgtggcataaactgatactacaaaagcacagatcaccaaaatagtatatataaaatatatatacagcatattatgtattatataatatgtggtctgtggtcctagatatctatacacacataatgcacacacacacgtaagttatgtgtgtgtgtgtgtgtatatacacatacatatacatatcctaatctggtagcacttttgttgttgttgtttagattcagggggtacatgtgcaggtgatctgtattatttattcttccttgttccatatatattagattaaccaagatttaaatatcagctctattactaacagtaacacctggaccaagttatttaacttctgtttacttataagaccataaatatataaattaatacatttaaggaatacttactgaatgctggtagagtatgagcacttaataaatgctagtagttgctgacagcacttatgaccaaaacactttcacaatcatatatgcatcagagccagggctgccgtttaaaatataatgttctcatttgcaacgggagaaatggcacgaaaatccaggcccctctaccaccggtatgtactctttccactactcagacagaggaatacttacatttgaatgagaatatccaatcttctaaaaattaactgtaaaccaaacgacaaaatttaaatggagagtgtttggggggctctggaggaatttgaaacttgtatttaatttcctggctcttcatcctgaaatgcgtctaagctagtaacagacagcaaaaccgagttcctatctctctagtgttccctgctgagataaaagcgatgtgcagcaccggatgccaacagagcaaataattacactgagtgctctttccacagccaatgaatcggaaagtgaaatttttgtggatgcacctgagtgctggggacatcagctgtcctatgagaagtcattaacattttctgaatgtctactgtgtgccaaacactgattactaaagaggacgcaaattgaaatgagagattattcttgtactccaggtgcttaaagccgttattaaggatcatatcacatgtccatcgagaataaaatgtcaggtaagaaaaattccatgaagaagaacagagtgctaggaaaatgcaagaaaaggaatgattaatgccagctagcttggggagggggctatgatgagagaaaggctaaggacagggacagtgagacagggacagttctctctcctagaattattaggaggtaaaaatttggagctcttctacttatgattaaacagaaagaggcatgaggagaaaaccaaatgatgtcatcagaataaaaaggcactgcaaaacagtagattatacatgcaccttgaatgtgctgtctgataaatcagcattttacaaaaacacatccggactagcaattcagaagaaagcaatgttaatgcattaattcaaagagagcaagccatccccaccctcaccccataggcttttatttatttatttatttatttattttagcagcctataatctctaggatttaaaaaaataactcaccaatgaacagaattaaacttctcaggtctgttgctttaaagaatagccaatatttgtgagaaacaatttcaagagaagattactacaaaatgaaaatgtaatatgtctgcatcagttaaatctcccaaaacaaatttgcaatattgcctctgactttgacgattttattctttcagtaacagtccagatggcatccaatgagtattgacatcatcatcataaaaaaaggctaagaaagtcaaaatgggatttatttaggacaaaaattaatatcaatagataatgatcttaaatttaaaggatgaggcatgaaaaaaacaattaataaaccttttatcttcctggaagatttccatttgatatgtatagtcatttgttgtgaggaatagaaaaaaaaaaagacacattaaagagtgtaaaaggctataaggtaccttgagaatgtagaaaataattattatttaatgaaagtgatagctaagaattcaaaaaataccctttggctatctgataagaaaacctatgccgatactatagcaaatctaacataagtaattttttggccttgcaatagattaactacctaggacgtaagaaaatgtctaaatctgggcttaatccaagcctctggaggtggtaataaagtcattaataataatggtaaaaactataataatcttttcagtttttgctcaccttctatgtgttccatacaccagttagaaatactgaattgtccagtgacatcaccataaaaaataaggataaagtccaaatataccatttttttcttgttcatctgttgtgtatgcgttatccagagtcactcttttagaaccatatatatttttaacacatgactggtaacaagttctaccttttaattacataggctaagtaaattactaacatctcttttatgtctgaaagcttccttttcaaggaatgccttcttatggaacctctcaagctctgtgaagtctgcctgaagactggatttaaaaatagcataaaatggtcctaatttaatttatggcctgaggagcccatattcacgtggtttcgaatatgggtaggattgttttctttttctgtccaatatcctcccacctcactcaagaccttacgtggtcttattgatcacgggagcacactggagcggtgactttatgaactaggctatccgtgacccttgggtccctttaatgggccttaactgttagtgctgaacctgccctcccaaaagtcacctttgcattatttttcataaatgtattattttctatgtgggtcaactggatctctcttgataactttctgttcttcacatatctcaatgttctcatctttttttctttcttggcttagatgcccactttttagtacagtctgacataatctgcaagtttgaaaattccagatgcctataaagataacatttaaatgctagctaagataaaactcaacaccagctgggatcccccaaacttccagaaagttgtttgtttatgcctgcactatgtttgctgccttttatgccactccttaacctgccaaaacagtcccaaacactgccatggagaggcctatttggggtagaaatgtattagaggtttggggaaacactaaataaagtacatcgatttcccctttcctcaaagtcaagaaacaaagttacaatcttagtgaagttcaatatttcttcatagactcttggccttgtgcctgcacaatgaatggatcacgtcaggttcccatgtagggatgagagaacaggaagttcattcctatgattcttggagtctttttcagagagtacttaaggataggcaaacagtattctgtaggcacagtgatatatgttgcagaaaaatgtgcattttggtccatcattaatgatttactgttgagtacagtttacaatcttaagtaaaataattcatctccagagatttatttactgcttttggccacacagcaataaaatgatttggttgtactgagaagaatttccctttaccaaggccatcacagggagaaggtatggtgttccaggtaaaggatagcataatagaaccatttcagtcaatcaacacagttggtagtcagagagaaggcttctttgtagatgttgatagacatatttatgtatttggaaagaattttccctttatggaatagagttattcagaagacaaagggtccagctaagtttgggaataagtcgatacacctgagttacttgcacagaaatatctcaaaggaattattgtaattatgtaattattgtaattcccttgagatattgtaagtcaatggaagctgtgaaggttttattttcccaatccaaaatcacctccagtcccaataatattcactccaaatataaaatggcaaattcacatgttcagaaggcactacacagaagcagcaccacaagcgacagctatctaggaaaagaaaacagtccctgagactagaatatatggctacaaagaaaaccaaagctaaaatcaaagcatttagatattgccaattttgtactgttccttcgaacattctggtgaaaataagtcagagcttgtctttcatcttggtcgtatcagatggatccaaccacatttaaaaacaaatcatttctctaattactgtgatggttactagaggctgggaagggtgaggggtgataaagcgaagttggttaacaggtacaaaaatacagtctgatagaaggagtaagttctagtattcaatagtacattatcgaaattacagttaacaataattgttgtgtatttcaaaatagttagaagagaagaattgtaatgttcctgacacaaagaaaagataaatatttaaagtgatggatatcccaattaccctgacttgatcattacccactttatatatgtatcaatatatcacatgtactgccaaaatatgtacaactatgatataagataagataaattatttctctacaaatacaatgagaactttgtcattgcccagcaggatttagctattagaaaaagaattatattaggctgggtgcagtggctcatgcctgtaatcccagcactttgggaggccaaggcacacgggtcacttgaggtcaggagttcaagaccagcctggccaacatggtgaaaccctgtctctactaaaaatacaaaaattagtcaggtgtggtggtacctgcttgtaatcccagctatttgggaggctgaggcagaaggcttgcttgaatctgggaggcaagaggttgtagtgagccaagatcatgacactgcactccagcctgggcgacagagcgagactctgtctcaaaaaaaaaaaaaaaagaaaaagaaaaagaaacaaaacaaaacaaaacaaaacaaaacaagacaaaaaaaaagaaaagaaaagaaagttttatgtcagagcccaagtggttgagattaacattctttactatttctaaccacttcaaggtgctaatttacaataaggaaagagtaacaaccattaggggaatatagactctttcatagcaaggttaattgaagtgtccatttgactatgtgacatctcactttcccctcttgttccgcagctcgattggctatgtagttattatgtgcaagttgcatagttactcagttctgtcagagaggatgtgtgaagaagatgaaaaagaaaggactagctttttgcaaattggtcatgtctcttgcggatctagttaacatttcctgttttctgcaagaattaatttttttcctaatgaactttaagaactaccaatatttttagtatactctttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacactgagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggactagaagtcaaatttcaacagaagagggcaatgagactccgtgccttaattatcaacatttttatgatgaagaaccttcctaaactaatgaaaaatacaagacagaaacagatgaaacacagaaatggctgaaaagaactccctattaatttctgaccattttcttccctattaacagtgcttgatgatctggagtgaatacctgcctttttggctcctgccaattagttcaggaagttccatcttcaaacacattcagtgacctgatttaataggggcctttttatttgatcgccgccaacaggcagtcctacagacttttataatcacagtgggctgctttacaggcaagtcaaattccagtttaatgaaaacctacatcattacaaggaattgagaagggaattctggtttcttttctgctatggcttacactggaagcatagtaactttccaatgaatccatgcaggagaatggaattcatccaatagggaaagcctcatttttctctatggtagaatggtagaattaatgaatatcaagaacacgagaacattttgtaacatcctgctggttaagtatgtttcattcctagctaggttaatatggataggctgggggcagtggtggtggatatttccagagatattacctgaagtttaacaaaacattggttttaagcttgtacatcatgaactcggggacagcttctctctcacactctatttatttatttatttttgagacagagtctctctgtcatccagactggactgcagtggcgtgatcttggctcactgcaacctccgcctcccagggtcaagcaattctcctgactcagcctcccgggtagctgggattataggcccgcaccatcatgcccggctaattttttatattttttttagtagatatggggttttgccatgttggccaggctaggctggtctcgaactcctgacctcaggtgatctgcccacctcggcctcccaaagtgctgggattacaggcgtgagccaccacacctggcctccctcatactttcttatgcaccaatcatgacccattttgaaagaggcagagtggtggaaggtttggacttcatgtgctgactggttctctttgttaagactcaaataaaaccactggagtcctatccactgaatgctagatctcaagacatagcacaatgggattcctggttacttacaagcggtctttatggttccccagaacatcttcccttgagcctgcttcccttgctgctccaagtgaactaaggccagaaactaacagcaagcacacaggaactgtgggctctgtgctcccctcggtgtttctgttccatagaggcccatcatctttagcgacttgattttctcattccacacacaactccaacaggtatctcatgtattcattggtttcaaatatgtgtgtgaataaatccctctaaatttcagacctgtatatccaacagtttccagggcatctcatctggttgttctacatacgttgcctgaaagtgaatatagccaaaacatatcatgccttcgtcattctctccatgaagaaagaaaggaagagagaatctcttgtgtttcccaatgtgaaaggcatagtggtgcattcattgtcaaagtcatacatatgggtgacatcactgttggtagggccttctcccttaactcacctgcccccctcacttcccgcaccaccacccctaatcctcccattgagttagtaatgaagtccttcctatgtcctgaaagtctcccgtgcatcctattttttcttaaatctcactggcctgccttgggtcaagccttcatcatctctgctctagactacagccacagtacccagccttgtctcccttttctaccatctgatgtttattctctacatttccccccacccagaggaatatgtttggaaaaaaaaaaagaaaaacaaatactgctatttccctgctcaaaattttcaatggctctttactcttttcaggatgaaatttgaactcctccagattctaactgttgtcttctgccttcctctctggagtcatccctctgcactttccaaacacctcatcctgtgcaaaggtcacgcgacaatatttggagttcccagagctcgccagaccctttcacaccttcgagctgttgcacaggcgctcctcttttccctggctaagtctgactcaggctttacaatgaagctctgacatcaccatctccaagaaaagcctctgaccccaggaacctgagtgaaattccacacactcctgcagccctctgggtttacctctattgtggaaattatctcactttcttgatttgtccttctcctccctagactgtgatcccctcgaggacagacagcatggcttaattctctgtatcgctaggcctgacaaaacgctcacacacagtaggctcctgaacgatgtttaatttattgttaacacataggattccacagatcctgaggtacagcagacttcagatacccacttcaaagaaaacaagggagtaatgcctaggttcttgttcctatgatttatactgtgaataaaataatttcagagaagttcctttattcacttgaacaatatttaaagggcaaaaaaaattaacaaaaggtctttttaaaaatgcaaataatttacatttgttgataaagccatacaatcacaaaagtgaccatatgaatgcaaatattccttctaaaaagtataattattattcacccatctaacaaatattaatgaacccctctgatgttagatgctctttatggtacaggggttagcagagtgggtacatggaagcttcctgtagtttacactatcatctggaaggcgattaatcaaatactacttactgttcatgagtttataattataaaatggagggaaatactctgaaagagaagagtgtggttttataaaaccatataagaggctgggtgcggtggctcaggcctgtaaccccagcactttgggaggccgaggtgggcagatcacttgaggtcagcagtttgagatcagcccaggcaacatggcaaaagcccgtctctactaaaactacaaaaattagctgggcgtggcagtgcatgcctgtaatcccagctactcgggaggctgaggcaggagaatcgcttgaacccagaaggcagaagttgcagtgagctgagatcatgcaactgcactccagcctgagccacagagcaagactccatctctctctctctctctctctctctctctctctatatatatatatatatatacacacacacacatatatatatacacacacacatatatatatacacacatatatatatatacacacacacacatatatatatatacatatatatatagaaactggcttagacctaaggtgagtgggtctcaactgggcataggggaaaaggagggaaagcattttagatggaggaaaaaacagggcagggataaatcttcaagaccagagtggccatggaaaagtcacctctataactagaatcaagagagtgagagaggaagtgataccagatgaggtctgagaggcagggagggactgatccaggatgctgcttaagggtgaagaggatcagaacacgccaccaaaaaacataccattttggcatactgattattctgaggtaaaggcaattgagaaacagaaaatgcatgaagggctctccacctttcccttttctgcctaaaagcaggacataggtaaacgtacccttgccaaaccccaaaaaccagagactaaaatgaaacacagtcagagcccagaaatcatattttaaccatgaacaccccaacaattaccccctgattgacgtaattttcctaaaaatcttaagcccctccaactaaattaatcctccattttgtataacaaatataaaaactaaacttccaccgtaatactaataccttcagcatatccctctgaaaatgtgtatgtttctcctgttaatctgtcttttgttatcttaattagtaagaaccataaacagaccataagagagaacaggagcactttgggaggaagaggtgggcagatcacgaggtcaggagatcgagaccatcctggctaacacagtgaaaccccgtctctactaaaaatacaaaaaattagccgggcgtggtggcaggtgcctgtagtcccagctactcgggaggctgaggcaggagaatcgcttgaacctggcaggcggaagttgcagtgagttgagatggcgcgagttgagactgcgcgactgcactccagcctgggccacagagcaagactccatctctctctctctctctctctctctctctctctctctctctctatatatatatatatatatatatatatatatatactggcttagacctaaggtgagtgggtctcaactgggcataggggaaaaggagggaaagcattttagatggaggaaaaagcagagcagggataagtctccatgaccagagttgccatggaaaagtgacctctatagctagaatcaagagagcaagagaggaagtgataccagatgaggtctgagaggcagggagggactgatccaggatgctgcttaagggtgaagaggatcagcacaccaccaaaaaacataccattttggcatattgattattctgaggtaaaggcaattgagaaacagaaagtgcatgaagggctctccacctttcccttttctgcctaaaagcaggacataggtaaacgtacccttgccaaaccccaaaaaccagagactaaaatgaaatacagtcagagcccagaaatcatattttaaccatgaacaccccaacagttacccctcgattgatgtaattttcctaaaaatctaagaccctccaactaatcctccatttttgtataacaaatataataactaaacttccaccctaatactaataccttcagcatatccctctgaaaatgtgtatgtttctcctgttaatctgtcttttgttatcgtaattagtaagaaccataaacagaccataagagagaacaggagcactttgggaggaagaggtgggcagatcacgaggtcaggagatcgagaccatcccggctaacacggtgaaaccccgtctctactaaaaatacaaaaaaattagccgggcgcctgtagtcccagctactcgggaggctgaggcaggagaatggcgtgaacctgggaggtggagcttgaagtgagccgagatcgcgccactgcactccagcctgggcggcagagtgagactccatctcaaaaaaaaaaaaaaaaaaagagagagagaacaggaaaactttttttcttccatagggatcttgtttggaatttcggtcttaatcctaaaatcaaagatggattttaattggacaggtttgcaatttgaaaatagtagtgtggctgccctttggagaaaggcaggatgaggtgcaggtgcatgtggagactagttaggaatcaatgagatagttcaggtaagcggagataagattttgcagtagagaaatacaagcatacatggtccaagctaagctgacagcacttgtggatgcaacagatatgagaagagggggataagaagagtcaaggcgaccccggcatttctggcatgtgcaatttttactgaggcagaaaccagggaaggggctgagggtaagacaatgactctcatcttggacatgtgcagtttgagacttctttgacatacccaagcgaaaatactgtatacacagttgaatttactggagttcagagaaaaggtctgaattagaaacatacatttagaaatatttaatttaagccatgagacggatggcattgccttgagaaaaaaaaagtagagtgagatttccattgatgtgttgctatttcaattaccttgtaaatagtctagtttattattatcttatcctattaattgttcttccactctttctccttcactgggttctctgaattatagaatttatgcagaaaacaaacttggagatcatcagatataatctccaaattttacaggtgaaaaaactatagtgggttactcaggatcacactgctccttagaggtaaaaatgaagacaaaagctcaggtgtttttgatgagtactccacaggactacatctggaacaggagcatgttgggagatgaatgtaagagtcccaggtacccagaatcctaccaattctgacatgcgtgtgcttgtcataatgaaacaacacaggacatcatgtgaaggacaactaacgtggggttacccatgaggtggtgagaaacagaatgggattttgcctcaaacccactgtggtttacacattagtaaactgttcaaaatggggccaaaagcttgaactctctgaccctctatttccttctctaggaaatggagaaaagcaatcattaccttgaagtgttgaaaggaataaaacgaatgtatttaaagccactaaccacatagaaggtttccaaattactaactaatattttcctccaaagtaaagaaaaaaaacagatgtcatcaaaataataaagctggccgggcactgtggctcacgcctgtaatcttaacactttgggaggccgaggcaggtggatcacgaggtagggagatcgagaccatcttggctaacacggtgaaaccccgtctctattaaaaatacaaaaaattagccaaatgtggtggcaggcacctgtagtcccagctactcgggaggctgaggcaggagaatggcgtgaacccaggaggcggagcttgcagtgagctgagatcacgccactgcactccagcctgggcgacagagcgagactctgtctcaataaataaataaataaataaataaataaataaataaataaataaataaaaaagctggccggatgcaatggctcgcatctgtaatcttaacactttgggaggaagagacatgaggatctcttgagtccaggagtttgagactagcctgggtaatgcagtgagaccctatcactacaaaaagtttaaaaaattagccagatgtgttggtgcatgcctgtagtcccagctacttgggaggctaaggcaggaagattgcttgagcccaggaatttgaggctggagtgagccatgactgtgccactgtgctccagcctgaatgacagaatgagactctgcctcaaacaaacaaaccaaaaaaccaactttattatttaaaaaaatctcaagggctcattgaaattatttggaaacattaaaatattttttaaaatattaaaaaagcaattattccggtcatcagggtttaaagcctatttattatataatgcacctaaaatttataaagcacccatgattatgaatcaaaacatctatatccaaatagtatttgatattattatactgtaatgtattttctagaatacagcacacaagaaaccacgtgctatttcaatatcttgttaagcaagtgaaaacctatgttgtcagttttaattcactcaaatatgcctgtagccaaggtaaatggtatagtttaaaatagtaccacaaatgaagcaactatcttacaaatttaaaattaatcatttcctcttttattcataaacttttatgcttcatctggatttggatctctattcttctaaaatttagagttttaagtacaaaggattttttagctggtatgagtgttatagtttgctttaccaaagattttcagatgagagaatgaataaacattgtaagttacaggatatgaattccagggaaagagctatcatgcaagaataagacttatggatttcatttacagaaaatcttcagcaaaatctacaaatatatttttagctatatagttattttttcaatttgaagacataatggtgttaacagtgactgagcacttttatgaaactctcatggaataatatttgaacttcatctttttctattgtggtagagcacttgttcaaagccaagatgtatatccccacttgtatggggcagattccgggcaaaaccactccttaccacaaagcagacacttctcagatgcctcttcaggatttattccttacctgccttcaaaatatgatttgaagcaatttacaatatagcccccaacaaacttaaaagaacaacaataaaagatagaaaaaaaaaacaattagaagacaaagaaaggcagatatgtcagggatgaatcacatgagaaaaagaaagaatggaacattaaatttagcagtgaacttcttggcaactacagaaaaaaggaaaaggaaaatacaaattatacattattgtttttaaaaaggaaaaagtaaagtttatcttcaaagacacaattttttagtagtttattataaaatacatttattttattgtttttttcattagaaacttagagaacatgaaggaaatgtcttttagtacaatttcgcagaaatcacaaaataagatacaaataatcatctatctgcctgctctaaaggctttgatactattatactcaaacttcttaaaggtttttttttgtagttaaggacagacaattcaagttctttgttgaagatgagattacaaagttatagcctttaaacagttctgttcctacacctgactttttaaacctctgctaaaggaacttaccttggttcctcgtacaagttagttacacgtttattgctaatgtatatgtaatctatttccccagcaacggtaaaatactagcccacaaaacccagtatagttactggaacatagtgagtatttgatcaatgttcattgcattgaattaaaaatataaagaaaaacgtagttagcatgcatctaagaccagcagacaccaatcccatatttttaaaatcagcttaaaaatacatatttctataacctgagcttaatatttaatctaggggaaaaaataaataaaataaagtaaaataaaaacaaaaattatagattccctggttccatctcagcactaatgaattagaatatctgtggtttgcatttgaaatctgcattcctaagaccttctccagagaatttattgcagccatactccagagtggcatttcatcaatcccaaatattctccttttataacatttttcatgtacactccttttttttttgcaaccataaatactttgtgtccaatacatgtgctatgggggatgactcctaggtataattagaagaaatattgagatgggaaaagtttaagctagaaaagggaagtcgaagtcgaaaacatagtgaaacaaaaggtagatgttttactgtggaggattgaaggagatgaagaaaccagaaggaagtttgtgcagactgctggactgtgcctgaggactggggcaagagctgcaaagctaccagtaacccagtactctctgccttatcttctctgcttctccttccttacatgcttcactgttctcaactgcagacaggcttcctttgctgctctctgcacaggggcattacccagcccctaggttacattgcctcagtgccagacatacataaacacacacacacacacacacacacacacacacacacacagagtcacacacacacttcaccaaagttctgggaatctcaacagaagcccaggggagagagctgttagtcaaattctataatgtacatacaccactgatctcattccctggccctgagacaccaggtcacatacaacctgtgcagctgcctgagctatctctgcagctgagaaggcacttctggagaagaaggtaatgctgtgactggatgcactcaaggacatttctcatctcagagttcaaggaaatggcatagaggaattatccaaagatactgtcctatggtcttgggactatggaaaccaggaggttgaaatcaacaactctaaaaccaaaacaaaaacaaaaacaaaaacaaagaaaagtcttagatgtttcactggacaaaatgcatttagcaggaaaaacaaaaacaaaacacaaaccctattattaggtagattatatttgtcattgcattctttgacatgatctgggtctggattgcagatgttgcagggggaattggattatagcatcactttctcaacacagctgttttcacttgaggtggatatgggcattacttggccaccatgacctatgttttcctttgaagcatgggagttgtctggtggagttgggtagtgttcattctcccacaaagctgttgacagctatcaatcttaggggcaacagagactctcagcttgggagtaaaggaaggagaaagaactagattattcttcctaactgctttttccttccccaagtaaaattttttttaaaaagtcattagataggctggggtggccttgattgaggccagactgcagagatgattagagcccttcaaagaaaaagattggcacaagcaaggtggccactgatcccagagctctcaataaaacaagcatgctccccggagctgcccagcttctctgggtgcattttaaggcaatatgtcttaaactttagtgcacaaattgaggttctaatttagtacatctgggggtgggtccagatactatattttcttttaaaattaacaaataataattgtacatattcatgggatacatagtgatgttttgatacaaataatatatgatggctgggctcattcctataatcccagcactttgggaggccaaggcaggaagatcactggagcccaggaatttgagactagcctaggcaacatggtgagatcttgtctctaccaaaacaaacaaacaaaaaattaaaaatcaaccaggcatggtggcaggtgcctgtggtcccagctacttgggatgctgaggcaggaggattgcttgagctcaggagggtgaggctgccatgtttgcaccactgcactccagcctgggtgacagagcaagactgtatcaaaaaacaaaacaaaacaagaaacaaataatgtatggtgataaataatgaaaagtgagaaatgataaacatttatcctttttgagtaattaacatatccattatcttaaatatttatcatttctttctgtcaggacggctcaatgtcctcctagctatttgaagctacacaacatattattgttaactatagtcattctacggtggcatagaacactggaactatgtggctgtaatttcgcattctttaacacatctctccctgtaagtttccaagtgattctgatactaatggtccatggaagtaatgaggctttaaggagcacaaattggtaacttgagaaagttagatttacaacatttgcgatccttccttccgtgtggaacagtccatagcaaagattgactccagtctgcaacaactgcactaccctcctttcacatatggcaggacttcatcacaatggtttctggttctactaagggcaataaagtcagcggattccttgtttcattagaagctctgcagtagaccatgaaacatgctcagggagagaagggggaagctgaaagagctgggaaagccagcagtccgttgcgagttgggccacaaaagaatagaggaattaacaatccccacagattataagaaaaatctggggagggatactaactagaaaagactgaaaacttctagtaaagtgaatggagcttgagaacattataatttgggaatattaatataaagaagctgataagtgctagacataatactagatataccaactaaatccacgacaaagcatctaattgaacctacgaggcagagcacgcctgcaaagtttccagggaatataaaatgattacttggacctaattacattaacgtgaaaaatgtcattgatattctctttattgaatagctaccactgttattttacagcagtgaacattaaaacaattattagagattcccaggttaattctcaatctatatgtccaatcttatttttcaattaaaatcttaatgttgtcaaccaagaattcttccaacagcttgctgttgagatatttgctatctgaagaactcaatcaaaaattttagactccactagagtgggtatcacaaaattgcagccaaacttaatcagatgagcaaagttttttgtttagcctatgtattttcataattcctgaattagaatgcctctaagcaggccatacacagtggaactgaccagttcccagtgcaggatggcaacgtagtgcatttatctgcctgaattctaaaggagataagttcacccctttcattagctcatcaatatatatatgagtaacatttttatatgcgtgtttagatgtggagttaactctgaatccttgaccaaatggagcttaaggtttagctagggacatgtgcaaaataactctaagacaaagtggagcgtacaagagatgcaaaaaccaaggcctttgagagcacagaggcaaaagcttcaggagagttttcaccaatgagctctctgaactgactactgaagaatggatggaatttaacaagcagaatggcctgtaagtgggacggtgaggagaggagaaatggagtgaagccacagatgtaaaaagtgcaaggcatcattgagaaaaagcaagaaactagaacgaagtgggcataagagggagtaacagggaaaaaagaagacacattttgttagagcaaaatgtcattccacagtagctctcctcagctccaagctccctctcttctctctgacagcaacacaggtatcaaaccccgacacggaggccgcttccctattattcctgtcctgatctctaccctcttcctaggcttgacagcttcctgatcatgaatattctcttgatcctggtcatgaggaagcagcctgcaacccctgtacaggaatcccatgaagcacccttcccagccacactcagcatcagccgccttcttctccctcctcgctgctgaggcttcgggctgtctgatctcacctctttcctaagctgtgccaggccatgccccagcacatcccaggccccaaaactggcactttcactgccccctggagtcagagcacagaggcttatcttattactcttccttgtgtcttgggtttctccagtcattgccaatcaaacccgcgggggttcctcattttggataatgattctttcctctctcagtctcctcattttaaaataaaacaccaacaacaaaaaaatgaaatccattgggctatgtcttttattctgcatgcctagttattcactaaaccctcacgctctttcctctctattccttcagcccttggatatcaggacctgggcacccaaacctgttcctgcaacagccttacccttgtcacagtgctattgcccttactgaatgccaatttatcccgagcactttcatcacaatatcctctgccaaacattttaaatgtctccatatttccccttttatcagaattagattctttggctagctttcacagaccctcataacctgacccaagttctctacagtttggtcactgtcgagttcggtgagcacagttggtggtgacagcggtcttgagcgagtatggctcttcctcatctttcaaacagctcaccactgctctgcagaaaccctttccttactccccatcagtcaggaaaaagaaatcactgatttttttcaccctcctaatttccatatacaaccttcataacattgttttttatacgtctttatttattttaatattgttttacttcgcatttgttcattcggtctttacaaactaacctagagcagggtcatgatttttggcgttttgttttactatcatttcaagtgtttcacatgataaatataccacaggcattttataagtagttactgaataatggattagagacagagtttcaatagtgaacagctggaatcagttttaaagagttatctaagaggtacaggagaaaacagaactgtgctccatgcagacttaccagagaagacgctaggtatcttggaaagaaagcttttgaccgtacgaataggaattccatttttttcatcttgcatccgtgctatgacgtcttccatctaaacaataataacataattaaaacctttataaagttgaacttttttgaaaaaaaatcagctctcataacaattttgtattcctgttttgcccaactaagaacaatgccgtattcttgcctttctagtttttgccacattaatagtttaaatactgttaaaaagagatggaggaaacagcaagaaaaacagccatgttagggcccattaagctaccaataggaattttgtgctttgaatattgcctttctcctgatttcatgtaccttggttataaaggttaagatcaaagagtgtttatttcacaaggttttagaaaccattgtcatagcacattcatgcttcattaatgttacctctactgaaatcagtgcaaaagcaagtagagccttaaaagcatctgcttgaattgcttcttcaagcaagagaatttccgtgattttgttttacaataaagttctaaaacctgcctagaaatccaggactgattgccaactactattacatctcttgcccgggtacttactgaagtgtgttatgaaacaaatacacacacatacacactctcatgcacatacactcatgcatgtgcacatacactccacacatgcacatgtacacacacacatatatgcacacaagtacacatacacgtgcatgtacacacacatgcacacacacacatatgtatacaataaaatgaatgtaacaccacagccttctgtccgtttactagattcccctttatctttgtttcaatctcattagtacactctcttttacttttacaaattgctggtaattctaaagggctgtgcttcacaaagtcaatgtggaatttagttttgaagaacattcattcattcaaatcatagccacagacattactcatgtgcttctaaacctgggagatgcagagacacacaaacatacccaagtggtagtatgggacttaaaatccattcatccatttactcattccacaaccacttatcactaactctacaccagacatatgactgggcaccgtggatatgaaaatgcatacaatacagttcctaccctcaaaaaattcagtcaatagtgacaaccaaggtgaaatctgagtaaagtatgtagtttagctaatagtgttgtactaatgttaatttcttgttttgataattatgccatggttatgtaagatattaacattaagggaagctgagtaaagagtgtatgggaattctgttatcttttctttttatctataagcctaaaattatttcaaagtaaacagttaaaaaaaacacagtctaaactttatattaatgaattatcaaatttccattggccgggcgcggtggctcacacctgtaatcccagcactttgggaggccgaggcgggcggatcatgaggtcaggagatcgagaccatcctggctaacacggtgaaaccccatctctactaaaaatacaaaaaattagccgggcgcggtggcaggcgcctgtagtcccaggtactcgggaggctgaggcaggagaatggagtgaacccaggaggcagagcttgcagtgagccgagatggcgccactgcactccagcctgggcaaaagagcaagactccatttcaaaaaaaaaaaaaaaaaaaaaaatttccatcaacatagctttagaatggttttcagctaagaaatctaatgttcttggtatcaacggatgtattactatgttgtaatcacactatgaacagatgtattactatgacaaataactggagatgtggaaagaatgggttttaatgaaacacaggtttgtatttgactcttagctcttgtaattattatctatgttctttgagtaagttaaataacctctctaagactcagttttctgatccataaaatggtgataataatacttgtaataatttcttcatagcgttcttcatgggattgcattgggcctagggtggggtaaagtattttaagggcaaatgatacaacatatataaagcctggtacatatatagaacaacaaatattagaccaaatgtccatgcacacccacgatatctggggatgcttattctccaccttcatgtttctttccatgtggaaggagcgccattaccctaatccccttgccttgtctctgccccctaatttactccaggggagctgagctgacttatcagacagaagagctgggaatgagaaactggcctgcagggcccactctttttctcttggctagaagcccacatctaactctgctgatgtagagatgcctgccctagtgggtaagcaagtctattcaggattgtgtttcaggattaacagtgacttgtgcacaaacattcttccataatacctttatcagcaatcagggtgatgttgtgacccctacgtgcctgtctttatggttatagttctcagttggctcagaaatcaagtataaaaagaacatgatgctgggcacggtggctcacgcctgtaatcccagcactttgggagaccaaggcaggcagatcacctgaggtcaagagttccagaccagcctggccaacatggcgcaaccctgtctctactaaaaatacaaaaattagctgggcatggtgacaggcgcctgtaatcccagctactcgggaggctgaggcaggagaatcacctgaaccccagaggcagagcttgcagtgagccgagatcataccactgccctccagcctgggagacagagtgagacttcacctcaaaaacaaaaaataaataaataaataaaaaagaaagaaaaaaaatgattttatcaggcctgtaaaagaccccaacaataaccaaataccaaataccccacttcttttgtaataaagatctgtaataaagatctctaagtatagaaacatgaaaatagacatactctgatgactttttattttgttactatttgttcatgactgacctgccacaatgttcagaaatgcagaataagctgctttgtcctgcctcatatcagcctctaaacccttgtattatctgcttaacggtttaaagcaggctggattagagggacatggaaacctctctgactcacactttcatctcagcacctagagatgtggcagcagtcacctctgcttcgggctgaatttaggtgcgtagctatgagtggcagtgttttctttgtatagtctcatcccctctcagttcatgggatcccaaaggagtgagaataggaggctggaaagtaaaagtgacttctgtggttgtattccaaaatattccatttttctgagtcatcatttccacaagagaaaaaaattttaactccaagtaaaaataggattggtgttctagactgaaaacgtgatcatgtacatgcattcagctgtttttatctttatccagacataatttatccgtgaaccttctcatggcctagaatgagacaaaaacaaacaaaagaaaacaacaacaacaaaatgaagaacaaagacacataaaaaaaacccctgctttctaaaaactaaaatcaattaaaaagaaaaagaaaattctagccctcaaatgactgaagggaccccctcttggctaacgggaccccagggaaaccctggaagctaagttcatggccatgatgggatggggggtgggacacacctcgttgtaccccttcctcactaaccactatcagcctttcttccctaaggggcaaacagaaactgacccttttgaaagactccacattgataatgttgattaatgacttatcttcccaggacagaacaaagctaaaatgagatcagtcattccttcactcctctctgggatgtctgctccctccattcccttttttttcaaatgttcaccttatcttatgtaaaaagtaaacttacagggcactaattaaagtctcgcaagtatgtaatcattcctctcactgttgcctcctcttttttaaggaaaatgtataaatactaaacctcctaagaacctctgggaaaaacagccaaacaggcatccataacttgtcctcaagctggctcaacaagcttcagtgattgagatttatgtctcaatcactcattttggttgtcacagtcaccaagtccacataaaaaaacacatgcatcttatctgttgatgttccctcgagcattcactcagagtctattaatttttatattaagcatgacttgaacatgcttgatggtctgttttcccactattagcaacagcaattggatgagaagaaaaatgctacaagcaagcaaaaaaaaaaaaacagagcaagttagttagacagtaagaggtatgagggatagtaaaaagcaactccaataaatatgaaaatatttggggcaatttagtctaaggccaaaagactcaggtacctcaagtatcccatatatatatgtatgtgtgtgtatatatatgtgtgtatatatatatacttacacacacgcatatatatgcatgtatacatgtgtatgcacacacatatatgcacatgcatatattcattaaaatgccattgagttgtgtgttttcacttccataagcctgtttctgagggtgaggaaactgggcatgggagaagagaacactagacgatgggcatgggcaggagagctggcatgccttgggtcaccgaggatttttctgaaggctattttctttactcttaagaagttcaaagtagatgatctgtaagacttctcctagctacaaaatgattgaagtctggaaataatcatcagcattcagaaggaggtaagtttccacactaggtcaaagagccaattccctgttacagacaaatagatgaagctattaaattaaataaaaccaggccaggctcggtggctcacgccagtaatctcagcactttgggaggccaacacaggaggatgacttgagctcaggagtttgagaccagcttgggcaacatggcaaaactctatctcttaaaaaaaaatatgaaaatgaactgggcatggtggcaagcacctgtgatcccagctacccaggaggctgaagtgagaggatctcttgagcctggaaggtcaaggctgcagtgagctgtggtcctgccactgcactccagcttgcgctacagaatgagactctgtctcaaaaataaataaaataaaataatcaaacaagaccttatacaaatgtatttgcttccaattgtcagcacattttagtttcaatgcaagacgtagttattaaaagcatgcatttaggccggttagacctgagtttgaatcctgactgtactacttacaagccatctgaacaggtgagttaatttaacactcaaagattcggttatctcatctgtaaaatggagataatcataaattgtatacatcttatcaagggtgagaattagtgaaacaatgctaattaaatgcttactatgatgccaccaccaacaccatcatcatcatcatcatcaacataattttcttccttcatcgttgtactaggaagatacggatcctttttcttttataattcagccggcaaagatgctgtagttaagtgcaaatatttgttagacgcaataaattgtcaagcaataagtagtcagagatgcctatacataagctctgtctttgatttcctgtaaaaaactgagttcatgttggcccctgcaagacaggagatttgatttgaagaaatgtcaggggaaatatttgtgcatataagcaaaggctatgtaagctatgaaaaaaatcatatttagaaagggaaatgagatggcattcacttttaacaaaatgaaaacgtctttgctgtcatcttttcttgacaaatttgcctcttgaagttatttagattaaaaattaaattaaattgagtgctgtttgcaagacttaattttttaatgcaaactgattcactatgcgtgataaaagtaaaagttaaacaagtgtattttacaaagtaattttgagaatatgtattgctgaactcattcaaaactttttatgcttctgttacagaaccctccatatttcattaactagtaaaactatctgttttcccttagatgtaaacttctggaggaaaaaattcttaccttactcatctttgcattgttaatatataaagtgtctggtccataatggaggctcactttaaaaagagaagaggggattgatgtatttttgtttaaggcatatgtttgcattttctgagagcctcaaaacaaaagtggaagttaatttaagatttggtcttgagatgtttgatatgtttttttctttgtatgtaacttttgtgaaaaatacattatcagcatcagaaatagtgacacagagtagctcagcgtagggcaggttaaaacactcttatccctcttattttttctgctctatctaatgcagatactccagcttacttgttagaggaatttcttcctttatgctctatctaatgcagagatacttcagcttacttgttagaggaatttcttcctttaatgcaagagagtaaatcagtggctgttgatgaggctgtcttcttgcttgtagatgtgacactcaagttcattgccatgtgtaagccctcaagatgaaaggcactattgaacttcaacaccctgctcttttctcaggaattcataattagcatttcctttggaatagtttagatgtcacttcaagcttgtgatgtatttcaaaaaggctcaggttaaacagttcccgcccgaacacttggcggaatgaaagaaggagcatattacacaggtccatcttctttgaagagagttactaattattcaagaggggctgccagacagggctcccacatattgatgaaaacaaaatcactgccttgaaacctttccagttctctaatgttctaaacaattatgggagtttaattaaattaacttgtagctatatttgccggaactttaccacaatatcattattattgatttcattaagccaatcgctttacagagacaccatgactgtaggcaaaacatttgttatgaagtaaagctaaaacgttttgtactctgtaattctgaaaaagaaatgaatcaatcaaaatttcagaagaagttttccaactctgccttacaaccaccattaagcacaggcatttggagatataaatgggagactaagtgggcagattgaatggcttttttctatgtgcacatactttcaaattatggtgtgtactgtcattttaagtgctagctatgaaaatgggagaaatgatcactgaagcgcttcttggatttcttgggcagttaggtggtggcaggttttcataatttaaattcgcctataactctttttacttcagaaagcctttcgaatgcagaaaatcatttacacttctgaattcatcagtgaaaacagagaaagtagagtcagtctctaatgaaagttaaattaagaataatgagattaaaatttgcaagacaaactgttttctgctgtaataattcaattaaagctgcttctaattgatatgatttttccccatgttatagtttattgcagtcagtatcttaactcagaattaattactcttttcatattaaaaaactgccattttcatgaataatcgactaaaaatagaaactagtaaaatcttattgcatgtaaatctgtcctagtttaacttaaatatagatttatttatttaaaaaacagtaactcagtgaggcatggtggctcatgcctataatcccagcacttgggaagccgaggccaacggatcacctgaggtccggagtttgagaccagcctggccaacatggcgaaattctgtctctactaaaaatacaaaaaaattagtcatgtgtggtggcaggtgcctgtagtcccagctaatcaggagtctgaggcaggagaatcccttgaacctgggaggcggaggttgcagtgagccgagatcgcgcaactgaactccagcctgggtgacagagcgagactccgtctccaaaaaaaaaaaaaaaaaaaaaaaccaacaccaccaccacacacacacacacacacacacacacacacgataacataactcatttgaaagcttagaagcttagaaacttagaaattttatccttttgtgattttgcagaaataaagtagaggttttttttctaatttatagacgtttctgcttttttttttttaaataaatcatttctctcattcatctcaaggaatataacctccactgaaaataaataaacagataaataaacaattatgctcactgtgtttgttgggattacttgggttgacagaatcccaaattcaattgtcatgaacaaagaaatgtgttgtaagtactgtgggatgtcttctggaactcgaagacgggcacataagtgggtctcataagcagcccgcctttagggcatgcttactgccccctccactctgctccttgtggtgagcccactttttcttctcggcctagagtcctctcttagttcttcaatgcacagaacagcaaaaatggctgcccttactgcttgagttttacagtttgtgaaattaaataattccaatttaaagctgttggaactttaaattatttgagctttgagaaaaatgtgactatatggcctgagcacatagcatgcagctgcaattcctgcttctccgattacagattacagtatgttactcttgtgctgtggatgattaggaaaggctgaaaggtgccataaataagagtctattactcctccttataaaatgtcgaatcagtcttccttggaatgtagtaaactataactaatcaaactcctgtaacataatctaagaattggtcttgcatgaaaaatgttgcaactctgttaacatttctgtctctacctatataagtgaaaccttacctccacacttggatgcactaaccccattcttttggagtctgtgttacccaggtggtgacagcctcaaacgttgtgctcaaataaattctacacttaatcatattttctgaatctcattatttaatgctgacaagtttatatgaacccaaggagaaattccttctctaatttccatacctgaattttggggcaaaaactttgatttataacactggaggtggagttggaaggggtgctgggcagagaaactaaaggcattcgttatcaccttattcaatataaaaacccattgaacgatacatggataaagttatatagcagaaaaaagtgtaagaaaagcagtctcaaaaaaataagagtgggtggttgctgaataatgagaaagagcccaagggccaggtgcggtggctcacacctgtaatcccagcactttgggatgccgaggcgggtggatcacaaggtcaggagtttgagaccaacatggtgaaagcttggccaacatggtgaaagccggtctctactaaaaatacaaaaagtagctgggcgtagtgacgcgcgcctgtaatcccagctatcgggaggctgaggcagaagaatcgcttgaacccgggaggcagaggctgcagtgagccgagaacacaccactgcactccagccagggcgacagagcgagactccgtctcaaaaaaaaaaaaaaaaaaaagcgccaaagaaagacaaaaattgatgcagaaaagaacgttggacagacaagtcaaacaactgaatgagatttcacagctatgaaagacagaaagacggaagtagcatgaccaaataggccaagtggttaattacattgcactcttcggcatggtaagtatttgccccgaggtagaaaataccaacgatgctaaatgtatgtgaaagagtaacttaggtttccagatttcttttttgttcctaggaggtatcacttctttaactctcaaaaggagcctcgtggctaatttttattgcagtcaaagttcaaataggagagttgtcaatgtcccctgaactatttgggaaagacttcatgggaaaagtaagattaagctgatcctagagggtaggcaggatagagagctataaaggaaaggaggaggcagagcacacgaatactttaatcaattgcttcatcttcggcgtcaagatgggaatgagtaagactcctgcacagaataatgaattctgtcagaatccttctccttctgcctctccaacttgacaattttaacctttctggaaggtgtctctgtagtcattttcaaacacaattccacctttgctatcaacttagttcacatactgcctgcttgaaattctctcttatacgaactccttacctcctgatcccacttgagctcacatcagttcgctcaagtagcaaaccccagaattaacctgggaacaagtttaaatatttcatctcttgtttaaaacttccattggcctgacaaccccatgaattttctgtaagcgaaatgaccacccaaatttatccacgatatgacgcccaactgtcattctagcgttataacttgcttcccacatgctcagcaattgctcctgcctgcctcaccttctcacatacacttcctcatgccagctgcgcccttcccttttccatctgtgcctgtggaaattcagctatacttctaggatcattccaaattgtaatttcctactgacgtccgtctttatccctccccctacctctctcatcccaacagaatatgatcatattctctgttaaactacttgagatctttatttttagtttaaattttttttaccctaccttactttacatgacttacatgtaagttatttattaacataaatatcattctctttagattataaaagctttggtaatttgcattagttttgctatctgtggcatggtccatgaggaattatcaccccccattttttactttacatacttctttgctgtgtttgtatgttcaccaacaggacgtattacttttataattaatattattttctatttgaaataattaagaattctggccgggcgcagtggctcacacctgtaattccagcactttgggaggctgaggcaggtggatcgccttagttcaggaatttgagaccagcctgacgaacatggtgaaaccgtctctctactaaaaatacaaaaattagccgggcttagtgttgggtgcctgtaatcccagctactcaggaggctgaggcaggagaatcgcttgaacccaggaggcagaggttgcagtgagccgagattatgccactgcactccagtctgggcaacaagagctaaactccatctcaaaaaaataataataataataattaagaattcccactttaatagtattaaaatattaaacgttaagttctttattcaaatgtctgttgtaacacatttgagggttaaatatcgccaactgctctttacaatatactctctgtaaacattctgtataattgctattgactttcaacaactaaactagtctacctccaaattatctctttttacaaccttttaaattcagagttaatgaacgaaattgtttacattcccttttttcttagtcacatctccaataaccctggaagtccgaatcaatagtcttatcatcggccccctttcagatggagagaccacagttcctgacagatgaaaggcttctcttgggactttttttaattgacgcaggtgcttgatttcagacaagcccttctattctagcttctggaatcaacttgaaattcagcaacctctatgtgtaacaaaaatggacgaatcattcctctaaaaaataaatgaacaatgatatttagcaaacaaaatacctaaagacaaccattgatttggatgagtgaaaaaggcagagaatgcagaagatgcctgggatttagctaatctctgagattccggcaggaaggacataaaaaaagtcaaagggctcttggctgagtttgccattttattttattatttcatttttattttattttattttattttattttattattgagacagggtctcactcactctttttttttttttgagacagagtctcactctattgcccaggctggagtatgatggtgcgatcttggctcactgcagcctccacctcccaggttcaagtgattctcctgtctcagcctctcaaatagcttacaagtgcccgccatcatgcccagctaatttttgtatttttagtagagatggggtttcaccatgttatccaggctggtctcaaattcctgacctcaagtgatccacccgccccagcctcccaaagctctgggattatgggagtgagccaccgtgcttggccaagcttgccattttaaaacattcttactaaaggaaaggggtctcacaatacctccacggagtataatagatttaaaatagctttggaacataagaattactctaatgtttcaattctttgatttaaatcccagcttctctttgtagccatttatgtctttgttgtttataaattcatacaaatatttcggaagccacttaagtttcccacctccttgggtaataaattctgtatgtaaattatctgctagttgaattcatatctagttcctattatttaattcttgcctcattcaagctcaaaagaagccccaccattttacagtatgagaatttagtgactaacaccttgtttatcctattcatggtattcgtacatccataaatgttgatccacactatctcctcctccttttcgtgagcaacagacccagtcattctcatagttctgtatggagcacatccttctacaattgtctgccccgcttgatatttgtgagggaaacctggccgaggccagataccatggttcatgtaatctcagtgctttggaaagctgagggagaaggattgcttgaggccaggagtttgagaccagcctggacaacatagcaagaccccccctctctacaagtaaaaaaaaaaatgaaaagacaagtgtaaaaacaatccagtctattgatggccactgggcatcacagactcgtttccagatattctccctccaacaccttcacacaactccaggactgatggtgggaagaacagccttatgcatgcttacttccatcctaatcctacactgcaaaccaggaaataagactgaatgtgcactgtggactaaaagcatctctgttattcccataaactgactgaaaacaataaatgtacccattgttgaaaataaggctctgtcatcatgtgttcagtgacgcagagcctagaacatttcagagtatcatgtaggtgattcttctctcaattctttcaaggctggtacaggactagtggcattccaaacacataggagagaagtttatttattacacacaatagatgcctcaggtcattcgagcttaatattcttatgaaacctgggcaggacctgtcagagtatgaaatgctccatctgaagccacaagagaaagcactactctgcttccactgagatgaaacatgaggactttggattaagtgtaggcagaagggctaaaaatatatatttttaatgatgtgatatcaagaaatgttacttaagtaatttatttttatggtaacatacttataaaatgcagcccagagatgtctctgggatggtcttagtagagttcttccaagagtaattaaagggatgacctcacagccatcaccaccgtatatatgatagtgctttgcctgggtccatccagctggcttagtccatgaaacaataccatgtttctaactaccattttcaaaatgaaattaaaaagggattataacctgaaggtagggcaaaagcactttaaaaggacaaaagcatcctcatgccaatgaagaagatttatttcaggtgtacacactaaaactaaatataagtatggtgatttatttgtcttaggtgtttcatggttttcaaagttttaaagtggtttctgcagctgctgaatctgacctttttctctgtgtaacactcttggtttacttattttgtacaacgatttttaaatttccagttcctagaattcttttaagatcaatgagtaaactgtagaagggcaaaaggaaaagatttctactttaattgtacccttgctagtgttgccgattcaaggcactacaacgttaagatggattttatttttcagaagtatttgaacagtgatgtcgatctttctaacccaccgaacaattagttttaaagcagagaaaattcaatgtgacttttctgacttgccttttatatggggatttggaaaaaacacctccttctggctagtccatctatgaaagaaggttctgcacaggacctagtttcaactactccttcattccacactgttctcaagagagaaattaggatgaatggtggacgaattcatacaaaatcccaaggcaaagtaggtccaagccttggcacacaaacatataacttctagtccaataactggctcttttatatccaccacaattttgttttccccacgagtgccaagaaaatcagaatgtctagttgccttcttcctgacaacgattctcaatgatcctatgaagaaatgaataaaaaataaaaaggtacctcacttattactagatatctgtgactattatcttatggctagaacacgaacatcagaaggtcatggcagtgatgttgaattatttaaaactatttccccatttggtaattgttaaagtcatagagacacctaggtagtttgaaatgccctccattgaaagccagcaatttctatgtgtctccaccagccaagaggaccctgtagagctttactttctatagctggaataatgaaaaacaataggttttttattgttttaaagaaaaaattaaaatactgactatatttttaaaactgcacctgctcccttaacgttttgatactcgcatggataaacaactttgataacctctggtgtaaagaacgtggcctttgttgcttagcagagccatgtgcaaatctcaggtccgtcatttgatgaatgatgttaggaaaataatttagcctctctgggctaggtctttgtactccttccctataaaatgagaatgctacttccttgataaaacatgtactttacagcataagttccccttccttctttctgtgcaaactctgagatgacgctatttctaagagtgcaacacttggaaatgaggtgtcttcttttctctggagctattaagactttctttattccctacttatgacacactctgtattacattatagtcatatgtgtacatgtcttatttcttttgttctcttttactgaaagtttcttcaggataaatattagtttaattacactggtttaatcactgtatcctgaatagtatcttttgggaaactgagtatacagagacaatggctagaccacatatgagcacagaattctgacccacagcccctgcaaccagcctgggaagccaaaccacaagctcagcagtagtaagtccaaaatggtcaagactcaggcaatgacaaccagcttccctaatttttgcctctgcctataactctggacaaaccagagaaagctagacactcctcaatctagttatattagatacccactttcagcttccccatgcaacaacctccagtcagagctcgctctttctctctctctctctttctctctctttttattataaagctttcccactcctctgcctgcctttgagtctttgccagacacaagtggtggtggacgattaccttgctacagcaagtgctgaatacatagcctttctttgttttcattttggtgaccttcatttacttccacattaaaaaaaaaattcatgtacatctcactgcattcccaagaagaatctggggtaaatccttgtccagaattatgtcttttatagaagcaaagtctccttccagttctaatattctgtgactaatagatgttgaggtcgaataaaatgctgatttgttgaacaacttttcagaaatagattattcctgtgtataagaattgtcaaaataagtaattcaaaatctaaactgttgaaactttcccttattttgagccctaaaagaatatgattatggggcctgagtcatgtgacaggcagctgtaacctaggcagctgtaacctttgtttttgtgattatagattagccttcttcctatattgttttgtaaaatgttgcaaatgactgaagggcaccagggaagaccctttccctctacgctgctgatcttcattacagattgactttcttctttcctttctcacacaaggactttacttgactatcacattgtctaagatggaatgccaaacatacttttaaattggaaaggaaatgaaaacaagctttacagaaaagaaaacaaactgtaaccaatcattacattgctgtaacccataaaccagccttgtatagaaaatgctgtaatcctgttaaatttgttttctgcttacataagcaagaccttaactttttacttctgagcactgaccccatttctctggagtctattttctgatggccattcccacctttgcactggaataaactctttaaaactagatctgatccttgcagttatttcaggttgacagaatggttcatgctgaacctccgaattaagttgttggtttaaatttttatgcaagttctaaaagaccaaattaacctcccaccacatcatacccagcaatattatactgcccagttaagagccatgggtataaaattacatgatttctttcaggaggcatttatccttctactaaatatcagttcattttttcaaaaatccactcgtccagctttgtgggaactgaacactaagaattctcaataggggaagaaacaattgtctcccccattgtatgtgtattgatttgtaacataacgtggggcgaatggtttgagcctggcttctccttctcttcttgccaaccctggtcccttgttttgggatccgtttcccttggagaatataaacattctttatcccacttcttgaaaggccatccttgtctttctagttgatgttaggaatgaactgacatggacgacaatgactatgacctatgtaggaaatctgtgaactgagtaagtagtcatatgaaaccaaatcttatgtgacctattgatatggtttagatttgtgtccccactcaaatctcatgtcgaactggaggaggggcctggtgggaggtgattggatcatgggaagggatttcccccttgctgttcttatgttaatgagtgagttgtcgcaatatctcatggattaaaagtgtgtggcacttcctccaacactctcgctctctcttgccaccacgtgtgcttcctctttgccttctgccatgactgtaactttcctgaggcctcccagtcatacttcctgttaagcctgtggaactgtgagtcaactaaatctcttttcttcataaattacccagtcgcaggtagttctttatagcagtatgagaatggactaatacacctatatttacactactctaaaacttgcattatacatgtaattttagaaatttttattgtggaaaatcttaaacagatacaaaaataaatagaatacagtgagccacaggtactcatcacccacctgtaaaaatcttcagtttattatgccaatttatgttttaaaaggaataccaactctctctatgaaaagtatgacttaggaaaaggtaccgtatataggtttttctattagtgtgaatttcccatgcataaagtggttgctctctcctagcaggctctggctgctggcttcccggcctcccttaatgctgtggatacctgtgacacaagacctggctttccttaatgcctatctaacttctttatttcctataagactccaaacttatgaaaaaaagagggtgacagacaacagttcatatactaataaagtaaaatttgacctctatttttatatacattctgtaaattttttttagttgacatataataattgtacatagtcatggggtacatagtgatgtttcaatacatgtaatgtatagtgatcagggtaattagcatatccatcatctaaaacatttgtcagtttttttgtgttggaaatgttcagtatcctccttccagctatttgaaattatatgatatatgttattgttaactatagtcatctgacagtggtatagaacactgtaacttatttcttctaatacacattatttaatttactcctaaccaccatgtaatatagataatgcaatcatgttaatcattcctttttagagataagagagctagggttctgagaattaaaccgatagatgtaaggttacacagttggtaagaagggggccctctacgaggtagtatatgggggcacatttgcaaagcattacaatggaagattatatttcaaaaaaaacacggcaaaaatgcatgtcagctttcttttcaaataaaatataaatgtccttgaacacagtccactctcaggggaaatttgaggaaaagacatatcatactgactatattccatttgattgcacacagtgatacaatcctttacatttcaaccaagacattgaaatgctcctacttcaagttctgattgttcacatgcattctctgggaactgctgcctggatgtacaggattttttaaactatgcagaacctacatcattcattctatatggcagttgttgaaataaacgtttagtgattctaaatacctcactaaagtagctagtacttattgtgaatctaccatgtagaagtgctgaatgcctgttgtggattgtggatggtgacaggaaaggaggtaagaaatgacttcctctgggagggatctttgatttgtgctttgaacactgagtgcaaatcagataaactgagtggagggacttaagcagaactgcagcaatgagaaaactcctggttaatttgacaggaaaagattgtttgcagagcggtatctgtgggataaagtggaagagtgtaatgtacaggcttgagtggaaatagaacatggataacaaagaagaaacaaccctaggaaaaagtaaagctgcaatatatttcttatcggattaatctaagatcagtgtggagaagccaacagagacataaaggacctcgtgtaagaaatcagacaatggcactggggacaatagccggtaatgcagagaatcaagcaagataagcatgaagtcagaatccaggcataggctggactaacacaatccttacctgcaaaatctgtaaaacttttgatagcaatctgcactaaaataaacatttttcatcatgacccagcacatacatgtgtattccaacatacatagatttaattgaaacaaaagttttacaaaacaatagctattctttctatggtagtgaagcctactatttttattctattccactgaataaaaattaaaatagattttacaaccttcttaaatgtttttacaacccacaactggaacatgattcaaccagcagttcataagagactattgggtacattccatgaggaaataaacatacgcaagaagtttccatccttaaacaagtttccacccaattaaacaattaaacaaaccaaccaatcacagtcctcctctggcaaccatcttatctcattttatttaatgccaaacctcttgccttccgcaaagagctgtctaacctcatagttttaaaactttttcgtctcaggacaactttacacttttaaaaattattgagaatcccaaagagattttttttaaaaaatcaaataggctgtacctattaatatttaccaattttgactaaaaacaaaactatcatttgaccctgcaatcctactactgggtatttacccaaggaaatcattttataatataaaaaagacacttgcactcataggttcatcacagcactatttacaatagcaaagtcatggaactaacttaaatgttcatcaacagttgacagaataaagaaaacatggtatataaacaccatggaatactacacagtcttaaaaaagaatgaaattatgtccttcccagcaacatggaggagagggggccattatcctaagtgaactaacttagaaacagaaaaccaaataccttttgttctcacttataagtgagagcacaacaatgggtacacatagacataaagatgaaaatataatagatactgaggactccaaaaggaggcaaggaggctgagggttgaaaaattaccagttgaatacaataatcactctttgagccacgggtatactagaagcctactttcatcagtatgcaatatacccatttaacaaacatgcacatgctcccctgctcacccaaaatgtaaaataaaataaaacaaaacaattaaaaattaaaaatttaccagctatgaaataaaaaattaaaataatcagtaaaaatatatattaattacttcattaaaatgataataataagtacattacatggtaacatgaatatctatcacaactaactatatttctcaaaacatatttggtaagaggaatgacgttattttacagttttgcaagtctcttccatgtttggcttggaagacagctggattttcacatctatttctgcattcaatcagttgcaatatgttgttttagttgaagaaaatccatccttgcacagaaaatgctttgaataggaagggatttttagtagccttatcaaacaatgaatgatactcttctctgctactataccaaaactccacaggtagtagtcagtgattacctgagatgtagaatctgaaacttttaacaatgaacttttcatactcctactgtactaaaattcattctcctattttggactttgaatggatctttttacccaggaatggcatgtactgatgacttggaaaatactgatgcactgagttatgcagatctcttaaatgctgacacaattcatcatacaatatccaaaatgacatttgttaatatcaccactgatacaatgagaaaagccttttactattggaaagctcccaggctcatcgtgacaatcacaagttttccaaaattataactttcactcacaagtttgttattggcaactaatactgtcagttgttttccttgaaatgacggtcttatttttttccattaaaaaaaggtgtgccaaatattcatgtctgaaacagcagagcttgtctttcagttattctttcaagtaacaatgactagctcagtttgcaactcaaataatagcacatcacacttttgtatgcagcgccttgatctcttcaaagccatcttccacactgtggtccgagtggcgtgttgtaagtaaatctcctcatttttctctcttattgaaaatacattggttttctcttttgactttaggataaagctcaaagtacttggcatattatgaggccctgcccatcctcaatgcaatccccatccttcccacactggagtttttaatcattttcccaggtgagccatcctcaggcctctaaggcattgcctgcctacctggttaaaatgggcttaccttccaagattctgctcaagttcaggggctttgagaagccttttctcatacaccttgctctctacataccactatcatcataggtctacttatcaattaatgttgtatttgtaattttttttgttttgttttagagacagggtcttgctctgttgcccaggctggagtgcagtggcactatcacagttcactaccgcctggaactccagggttcaagcaatcttcacgcctcagcctctcaagtagctgggactacagatctgcaccaccacgcctggctaatttttatctgttgtagagatggagtcttgctatgttgcccaagctggtctcgaactcctggactcaggtggtccacctgtctcatcttcccaaagtgtgggaattacaggcatgagccaccgcgcctggcctaaactgtgaaattcttacagggggaaattttgtactgtacagagatctttttaccagtacacatatgtgtccaaaatgatctcaggcctagaaaagccacggcctctagatagagaggaaaatagggaaactagctgacaagtaaagggtcactcctgatagcacagcagcaggctatggagtttggtgtccacagtttaagaaatggaggatagagggtttagagtggaggtgcacgagtgaggtgcattttaaataggttaagtaagcctgcttcacactacaatttgaactttggagaaagactcaaggcgaggacaccgtacctatatttagaccccagaagaaagctttgctccaggtctaacaggttatctctccatgagatagcctccacttctctctggattatgatctcacttactccttactccattactccccttgcctgggctcctgactctgaagattgcttcacagatttcaacagtaaatagatgatatcaggaaaaagaattcagaggccaaattgtaaaatattgggtgaaaaaaagtactggacagatgtcaaaaacctttcagagattttacttttctaacttgctccaaatatctctaaaaaggaattatggtttgcagtgcttccaaaagagcatagctgcagaaccttgttttgcaggagaatttcaagggctaaggtttagtgcaatacacctgggagagaccttgaggtatgtatgcatctaggttgagcgatgaaaggacaacaaaaggaaaagaaacaaaaacaaagtctctaaagagcagcaacaataaaatcatcacttgaaaacttgtttgaatatgtatgttataattgatgcagcctcacataaaaggtgacaagctatggttccaggataatatgtctgggagtgagggtggatgacagagagggttgtttggaagcttataggagaatatactgctctaaatttcttatcatgataaacttggaactttgaagtttagagaagaaagagtttatatatatgctagtctatccacctgtgttgcaattgttctttttttttttttttttttttttttgagacagggtttcactctggtacccagtctagagtacagtggcaagaccatggcttactgcagcctcaacctcctagctcaagcagattctcctccctagtagctgggacctcaggtgcgtgataccacacctggctaacttttaaattttttgtagagatgaggtctttgctgtgcaggctggtttcaaattcccgagcttacgcatttctcccgtcttagcctcccaaaatgctgggattacaggcatgagccactgtgcccaggcttaattctttttctgaaggtaattattaagttcttttccaagactgctttattacttttttgaaaaatcacttatacattgcttttgttatgcaaatgcagctgctatcttcagtgacattgttcagtaagttcacgcaaaagtaattcaacccttggcacttcattcatcctgttggcaagctgaaggagtagagagtgaaaaattaaatgaatatgtgatctgtagttagtacctataccttctatttagcattctcgttactctccccaatctggatgcctagtgtgtaccacagataccacagggttatgtcctgataaactcatcataagttgaaaatattgtaagtaaaaatgcatttaatacacctaactgtctgggcatggtgtctgatgcctgtaatcccagaactttgggatgctcaagctggtggatcacctgagatcaggggtttgagaccagcttgactaacatggtgaaaccccatctctactaaatataaaaaattagccaggcacggtggtgcatgcctgtaaccctagctacttgggaggctgacgcaggagaatcacttgaaccccgagaggcagagattgcagtgagctgagatcgcgccattgcactccagcctggccagcaagagagaaactccatcacaaaaagaaaaaaaaaaaaaaaacacctaacctaccgaacatcatagcttagtctagtcttaccttaactgtgctcagagcacttacattggcctacagtttgacaaaagaatctaagacaaagcctattttataataaagtgttgaatgtcccacttgatttgttgactcctatgctgaaagtgaaaaacacagtgatcatatgggtagtcaaaatacggtttctactgaatgtgtatctctttcacaccacggtatagttgaaaaatcctaagtcgaaccacattaagttggggaccatctgtaaacataggtgcttgataagtgattgtcagacacatgaataaatgagggaaatttcctgctcttgtgcaatcacagagacctctggaattcaacatagctactctcacaagtgctcaggaaccctagaggacatcaacaggggtggtgtcaatcagggctttttgatgacttgccccagagcctgccctgctgcagaccccaggtccttagcctcagcaacacccttggctctgaggacttcagtgtggctggaccagcagctccctctttttcatcactcattcattatttaatcagcctatctacctcaccaaggcctccccaacccagctgctcctttctgtccataaaataactgccttagttcaggcagttatggctgggtgaagcagagacaatgccactattcccaccattctaattatgacccacatcctggcaagtggattctccctaagatacaatcactcaaaggctcaggggcaagaaaagagaacatgggccggacacggtggctcacgcctgtaatcccagcactttgggatgccaaggcgggtggatcacctgaggtcgggagtttgagaccagcctgaccaacatggagaaaccccgtctctactaaaaatacaaaaattagccagctgtggtggcacatgcctgtaatcacagctactcgggaggctgaaggaggagaatcacttgaacccgggaggcggaggtggtggtgagctgagattgcaccattgcactccagcctgagcaacgagagtgaaactccatttcaaaaaaagaaaagaaaagagaacatggctttaggttttggtatcaaataagcccagaataatgctcaacccagaatgatgcagacctatgtcctagtcatggtagcatgggactgggtatccccgccatgctgtccaccctcaccttagaagagggcctgcccctggagaagcaggagaatgtgttccctttggcgaaagtttgaccaaaagaggaagaaaaatgaaccaaacatactcagatatttttctgaaagttactgatgaaatgaatcactccaatttcttaggtcaagcattaataaaggggtggggaaaagccagggatgtgcttagagagtatccctcttaagaagaaccaggatgggcatggtagctcaagcctctaattccagctctttgggaggccgaggcgggaggactgcttgagaccaggagttcaagatcagcctgggcaacattagtgagacctcgtctctagaaaaaaaaaaaaaattagccagacatagtgctgcacgcctatagtcccagctacctgggaggctaaagtgggaggatcgcttgagcccaggaggttgaggctgcagtgaactccattgcaccactgcactccagcctgggtgacagagagagaccctgtctctttgaaaaaaataaaaaagaaagaaaacaagaaccagaaaatgcatttttgttttcttctatcaagctttataaaagcattggtcaacagatggaagagtggttttgaggatagccctattccctcttaaggctgggatagagggttagggatggcattcaaaggaaaacgtctacctttagtacaaggcggttctattaaaactgtggaggcattagatggaagccagcagtaatgctttagaaccattctgggcttcctgcagagtggtgtctgctgggacctgaatcgtggcaggagatgcccagtgcacggggcccatttggtcaccagcagaaacaggaagggccccctgggagctgagccaattgtgtggacatgtgagacatatctcgggacctcccaggagagctatggaagtagtgataggacactgtaggcgctgcaggtaggcagaggcaaaagccagcgaacttgttactcatcaatggattctctctgtactaactgctgaggcctgaagaaacttggttatatacagaagtgtgaggcctcccttggagactaaagcatttgctccctcccaagacattaggcagaaaatactacttgggatggcaggttgttttgcacggtcatgcccttttacttcatgagctataatctagatgtcagctggggactctgtgtcctcatggtatatgtaggattgctttgaccctcccattggacagtgtgaagaagtcttaagccaactggagatttgtggtcattcttttcatggcttagctctatccacacaggcggtcattttctgggcctgcaccatgcagagtccaaactcagttcttccaccagtctccataacaatgctactcgctctaagcattttatgaggtttcctagaattcatgtaatatttaaggggataacaatgagagggctatatctcactgcacagtattccaatttctctaggtctttgaccctttttcctccaatcatctagatacccgacatgcacaaagacatggacacacacacacacacacacacacacacgctgaattcatcctccctttgatccacagaaaaccaagggttcctcctctgctctcccacagaacagcatccctcccactcagctttcagcttctatcctaaatatgctctgcaaggaatttgcccaacaaaggcacttctctagttagaaaaaaattatcatgccagttgctaaaacaaaaaaaacactctctttttctaaactaatttagatgcatagtaggtgcttagaaaataataagtgtgtaaatatttattactctaagtaaggtcctcttcagggtgaccctgtacagaagcagcctggggctgagatactccctatctaatttataaaggatcagggcaggcatacattaaatccttttttctacctcgatcttatttcctcttaggaactgaaagtgctttcagacattatttcagtaatccttgcagcttcccccaatgagaggaaaaaatgcccttatctccagtgcgcagatggagcccagagagatggaagttaagtgactcccaaggttgcccacagggagcacagagaagaagctaagctgcgacctggagtcttggtgaccccgttctagagttagaagataacgttgccttacaaagagttttcaaatgtggcagcttttgctctttgaaatgggaataattgaggtttcccatttatatttatttatttatttattattattattattattttgaggcagagtttcgctcttgttgccaggctggagtgcagtggtgcaatctcggctcaatgcaacctccgcctcccgggttcaaggaattctcctgcctcagcctcctgagtagctgggattacaggcatgcgcaaccacacccggctaattttgtatttttagtagagatggggtttctccatgttggttaggctggtctcgaactcccgacctcaggtgatccgcccgccttggcctcccaaagtgctgggattacaggtacaagccacagtgcctggccccatttatattttttgctctgtaatggggcatgggagttcatgcaacgggctctagatcaagcctgcttgggtcaaatgcgcagctctgctactctctagttactgaccttgggaaagttactcagcattttgttgcctcagcttcagcatctgaaaaacagatgtgctaaatacaacaatatccttctcacggagttattatgaggatcaaatgagtttacccctcctacctccagccccccatacacccactagagaggttaggaaagtgcccggtacagagaaatgctacataaatgttagctataattatttctccttttcgaattgtgcattctttatttagcaaccttaagttgattttttttttttttggtctaggtgacagcattgcctaactatagaaaccaaccttgtagagtcctaggcatataattaaacctaatatatcaccatactattgttcacttctttctttccttccttccttcattccagaaacactttccaagtgcccactatgtgaaaggtacggtattagattaggtacagtagtaaaggtaatttagaagataaatttggccttagcatcttatggtctaaggagaatatgcacataaacatttaaatttcaactcaatgtcaaggtaatatcatagagagaatccagaagaagcaacatctaattctgcttgatactatcaggaaagccttacctgaggaggtaactgagtcttgaagtagaaataggagttattctgacaaataaaaaatccttgaaatgtttgggcaatttgttcagaatacatattttttaagctcacatacaacaatataaaaagtaaccatatattagtgataaagcacgtctcaacacattttaaggattgaagtcatacagaaagcacaattctatgaagctaagaataaattactaaatccgtcaataatccctactcgacagccatcattctcagcaaactatcgcaaggacaaaaaaccaaacaccgcatgttctcactcataggtgggaatcgaacaatgagaacacatggacacaggaaggggaacatcacacaccggggactgttgtggcgtggggggagcggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaatttaaaaaaagaataactttccattttatcaattgaaattaatagaagtaaaagtttaaatagtgttgactacaaatattagtatatagatgtatgtatttgatgtaaaaacatagttttggagattattctcttcaaatgatttagtatatttcagaaagataagaggatgataaatttcaaccaaaaataataacactgagcttttaaaagtatacttgaaaaaaaagtacagttgcatagatttgaagaggaaatatagagcagtatgttatctaaaaagttcagaaaatgggtcgggtgtggtggctcacgcctgtaattccagcactttgggaggctgaggtgggtggatcacgaggtcaggagaccgagaccatcctgactaacatggtgaaaccccgtctccattaaaaatacaaaaaattagccgggcgtgtggcgggcgcctttagtcccagctactagggaggctgaggcaggagaatgacgtgaaccgggaaagtggaggttgcagtgagccgagattgcgccactgcactccagcctgggccacagagcaagactccgtctcaaaaaaaaaaaaaagttcaaaaaatggccaggtgcggtggctcacgcttgtaatcccagcactttgggaggccaaggcaggcagatcacttgacatcaggagtttgcgaccagcctggccaacatggtaaaaccctgtctctactaaaaatacaaaaatttacctggcatggtggcggtgcaagcatgtagtcctagctaccagggaggctgaggctcgagaaacgcttgaacccggggcggaggttacagtgagccgagattgtgccactgcactccagcctgggtaaaagaacgagactccgtctcaaaataaataaataaatttaaaaagttcagaaaatattttataatgtcaaaaatataaattacacagtatatgtatatatgtaaatatatacaaataatttacatctctataaaatatttcaaaattattttataaagcaacttcccagaaattgagtatttaaatgctatttggacatgcagaataataggcaaaaaaaaaaaaaaaaaaaaaactcttcagaggaataagtagggaatttcatacaaaggggtgataactcttaagatattttagctttggattaatttacatttccctaccccgtaatgatatgctcccttggggctagaaagaaagcaaattaaataccagttgaacaactaaattgattattatattgatatcccttcttcaaaatgttaacggaaggacaactactatttatacacaattagcatggaggagagacgtaattaaacataactttagataatttctccaaattatactcctctaacattttgaaaaagtttttaaaacagaagtgatataaaaacaggtgagcttcttaccctcagcctccatgctataagtaacactgaaattcaccataagattttcttgcaaaatgccataaatgaccttgcgtgtttaagtgtaccactgaggggatattggctactagaaacaaacaaacaaacaaaaaaaaaacggaactcaaaacacttcaagcagtaaaaggttttttgtttgtttttaaatttcacaaaatgaagtaaagtcccgaggcaggatgatttcagatttggttaagtcagattctttccgtattctgactctacattcatcagcatgggaccttcccagccacgacattatcacatttttacatgcctgtgcccaaaggcaaaaatagcgtcaacctcttacttttccttcctctaactagcaaaaaagcatcgccagcaccctcacagaagaaatctctttaggtcacaacagctagaattgcattaagtatattttataagccaataatcaccggcagagagaataaaacagacataatcaaccccctaaagagcagcagttctcaaacttgagtgagcaccacagttacttggagagtttattaaacgagatttctgggtggagcccagaaatcagtaggtatagggtggggcccacgagtctgtatttccaaaaaacttccaggtgttactgatgctgctggtccttctacaaaccccctgcactgccctaaagcacgtgggagcatcttagcaaaggggtgggggaggtggctcaggtaatcaaccaaagtgcatctgagatctaatattattttaaaattgcttttcaagaattcctattacttcaaattaaagatgtaactgagtgtcttctgagtattttagaattgcaaattttgatattctaccatcactatgctccacctctctgaagccattactagggcaaggatatagtgagaaagtttctgtcactgctaagcaagtgcatccttcagattgccaatgtgtcattgtagttggagctattaaacttctatgtggcatgaaaattgtttggctaactttaaaaaggagaaaaaaatggaagtggaggttagaatttttctagcccagcaagaacccacttggtaaccacttttagataaaaagcccaaaaataatatacttcaccagatgttcctttaattttccagggattaatttgagagtcaattacctattttaagtgattaacataaattaaaaaaaaaaaacactaggctctgaaccaatgcttttaactgtatgatggaccattgttcatttccgatacttttaagaactaggatgattttgacacattaaaaaatgtcctggaatgaatttgctattctgcttggcaacatttgaggaagtaaatactgctacaaatcctttaggtagctttcaattgtccatgtctgttagtgagaagagggacagtaagaaaaatgctaaggtcaaattcactcatgacttcatgccaaaaaaaaggtatttctgagttgataactctaaaatctttttctaagtagggacaagaattactaataacaaacagtggaaaacatactgaactaaaacacaaaatatctgaattttacaggtcatttaacttccctgagcattgctttcttatctgaacctctaaggattggatttggtgtttggtttcttttttatttttataacatccctttcagatataatccaaaggtgacatctcctttctctgtcctatccatctttgatgatatgtgttaataacagttaaatgcaaaataataggataaaaggcttaattacaaaaaaaaaaaaaaaaaaccaagaggccagataattctactctggaagaactggctgtaacatcatgatgatggcagcaatttagaaagccacattaactttgttacagagatttatttaacgccagtttgaagaatgacgtctttatgccgatgacatgattcatttttttttaatgagtaaaatgtgtttttctccattagactttactctctgtaccttgaaaataaaaatacctttccagtgtcatgcatgagtcatattgattctcaaattaaactaaacacccatagcacataggaaaaaaaagccaaatgacaatttagaaatgtaagggaatttgaatgtctactcatttacttgaatctaatcattaagatgaggatgttatttcactctttctagaacaatagttttccaacttgagtttgcatcagaatcaccaacaggaccagtaaaaacagacagctggacccaacttccagagttgccaagtcagtgggactatgtagggcctgaaaatttgcatttttaacaatttctcaggctacactggctgatgttgctggttgggaaccacactttgagaactactgtttgtagaagactggtaaaaattggtaggtgtaagaaagatattctttttagatatatgtctgggagctgggggcaaagtagaaaagcatttaaaaagcaaaaatgagagacacctgaactgtcatgcatttaccagaattttctctcataacgtggcagccttcactgtcctctttcctttttactattctaaatcaaaacattacaaatgtacaagctggaactgattatgcataatagctgatgttacttcactgattaaaaacaaaaaagcaataaactttggctccctctgcaagctgcccataataaaatgcagaggaaatatttattaatcaagcaaagactgaaagacatttcgttaatggtctgcctcatcacatcagtttgaatcacattacacatcccgttaagaagagatgatgcttaaaaatacagaaaactaaatgtggcattatcatccatcccaactggaaaatgtgatggattgtccttaatagaaagagtggtagtctattcatgtggtatgtctcgcaaaggaccgccaggctccaagagccaagtattctgatcactttttccttaatgagaggctcccataaacacaatttaatcctctttgaaaacctgagggctattttgtgtttaagtggcatacacagagatcattaaaatgtaaaagaactgtgcagggaggcccaatttttttccaggtggccatgcatcagaattttgttagaatgtaacatggatttgattgaatgattctcccatttccacatggagagtggagcccagagaattgtttaatcatgtatccatgattcaatattcatttatggagcacctatgctgggccagaggtactatgagtggggatgacaggatggatgtgacagacaggacccctgtccccatgcagtttacaggctatatcagtaattaacaagaactaaaatacttggcaaagaggaatgcttccatcaatgtttgtttaaattaaaggaaaaaaacaaaccccacaacgaaataatcaatacagttgtcacaagtgcacaggacagcatgaaagcccatgacacatattttggagaagaggtacttccattttttttggtgggggaggtacattagcctcaaatttcacagaatacatgcaatctcaaagttaaaaaatgggttttactgttaaggtctgtcaataattcaacttattatttgtttgtttgtttgtttgtttgtttgtttgtttgttttagacggagtctagctctgtcgcccaggctggagtgcagtggcacaatctcggctcactgcaagctctgcctcctgggttcacgccattctcctgcctcagcctcccaagtagctgggattacaggtgcccaccaccaagcccggctaattttttgtatttttagtagagatggggtttcaccgtgttagccaggatggtctcgatctcctgacctcgtaatccgcctgcctcagcctcccaaagtgctgggattacgggcctgagccactgcgcccggcaattcaacttattaatactagaatacattttctacagaaaaagttgtgaaaaattgtgatataattgtattgtagtacattgtaaaaattacaatacaagtgaaatgctttttatttacatttataaagaatagaaaatgtaatcataagaaataagagaaaaaccatttttacataaaattgaatataaacagcaataaatgaaatcgactatatatcaatttgataaaccacagagaaaaaaataattatttcaaataatttttgaaaatagttctttgacccattttaatgggatgtataagtctaagggcaaaaaaaaaagaaaaggtctgaaagcataccttaaatttattaatgggtttgttagtagtgatattctaattttgagacaatattgtagaaaactaaagagataggttgataatattagccaccataattttttttctaagggaaaggagatacaaatataaaaaaaaagaaaccaagaaaaagaacactcataatattaattttctcccacttaatttttctgtaatactaaatttgaattgaaaaatatagtgtgaaccaaagattataaacgtaatttcccttagggtttctactgaaagggtttagaaacattgacacagtagcaacaagcaaatttagttccctgatcctggtttctaaataccattccttacagaaacaacaaacaaacaaaaaacaaaccagttaataccaagtttaggtttggtcaaggtgaactggtgacaatttgttgtgccaaacactaatttaaatcaaactatgtgaaagaattcaaaaactagcttcaaaaagcattcatgagttcacaataagaaacagggagagagagaggcagagggagagaaagagagagagaaagggagacagagaatgaatgagatgccctccagcaaaggaaagcagtaagtccacgacatcatctatccttgccaaaatgtctatcctggatctaataaagcatcccatcctgcactgcccaatatggtagccattagccacatgtgactgtttagatttaaatttagaataatttaagttaaacaagttagaatttcttttcctctatcatcctagccctctcacatatggctggtggctactgtattgggtagcaccaacgaagaacagccatcctcacagcaagatctgtcgggcagtgctgctccagacctatcttccaaattatatggaaaccaagaaaccaagttaaatgacactacggggaaaccatatgacaaatccagactgacagaatgccgtgggacttctactagactattagcctgaactcttccaaaagtaaattgtgtttgtgtgtgtgtggtgtttgaacacctacatatgtatataaaatgcaattattattgtatactacaaagatgtaagagaggtaacaaccaaatgtaatgcgtgaatctggactgaatactgaattagaaggaaatctggagaaatctgagaatagaatggatattagatgactatccccacacctacgccatagaagcggaagtcactcttgttgtttataaaaggcccacgagggaaagtgccctactttttcccagagaggggaggggcttgcgggaaatgaatgggagagagttgaagcagagtgctgagaagagggaaagatttaccataactggaaaggaaaaggagttttactagttcctcactgaaagattgtccccggggcctgaaagcttgaagagatgagaaactcctcccctttcaggcccagtcccaaggcgcaaggccacttacagtaatcagcagcgtgggtcagcaagacagcggaagcaggacgacagccggccggaagacacctaccccggccggaagacacctaccctggccggaagacacctacctctgaagatggagaaggaggccgtccgggtactacgtagcagtcaggtcagtctgggacatttcctgtttacagaggactataaaacccctgtcctgtcctcatttggggctgacgccattttaggcatcagaccgcctgtgcccaggcgctcattaaaacagcatgttgcggccgggcgcggtggctcatgcctgtaatcccagcactttgggaagccaagacgggcagatcacgaggtcaggagatggagaccatcctggctaacacggtgaaaccctgtctctactaaaaatataaaataattagccggatgtagtggcgggcacctgtagtcccagctactcgggaggctgaggcaggagaatggcgtgaacccgggaggcggagcttgcagtgagccgagatcgcgcccctgcactccagcctgggcgacagagcgagactccgtctgaacaacaacaacaaaaaacaaaaaaagcagcatgttgctccacacggcctcgtgttgtctgttggcgtgctcttgggttcgagctgagaaccttacactcaccacttccgggatgcctcccctatctttttgcaactcttttttgagggaataatggcactgggtttacctagggagaaaggatactaaactctggggctcccaggtttggcaggctcttgtggaaaaaaacctgcccttgaaaaacccctaaccaaagagctttgaacaagatgatctgagtgggaactccttctcccacgtggtgtggccggcctcgtgtctattaaactctctactacaatgtcagtggcctttttttattatttttttttgagacagagttgcccaggctagagtgcaatggcgggatctcagctcaccacaacctccgcctcccgggttcaagcaattgtcctgcctcagccacctgaccagtagcctttctttatgcagtgacaggacgaatcccttgggtggttacatgataatgacaaaaaaaaaaaaaaaactagtttgttattctaagaaagacatatttgaaaaatgagaaaatttgttgactgtggacaataaaagacagtgttacaaacaatatatgagtctttttaagaggaaataaaatgtatcaaatcagatctatcgtccaccacatccctccttcactagccggtaggtgaagctctttcaagtgggtgagggtagatggtggaggaaagataagttttgttcaattaaaaaacatgtatagacagtctgcagtgtcagacactgtgctaagctcctcattacttcaggagcttgataaaaatactgatttcaaggcccagctcccagagattctgactgagtctttttctaaggtggggtccaggaatcctcatctttgaacattggtcttcaccctttccacaaggaatcacagtggagactttcattggatggcaccttgtgaaaacctgccctagtgttttggagataaggggggggatgttcatggggtagaggggagtgtcactctggagcactctcctgccttgtgtggccacagcacagtcccacagtgaggggccacgtggcactgcgcaccgatcttgagctatagtcacaaagctcctaggcaccacccacgaaaggccgggtgatggcagaacaaaaccatctggaaacctgaagatggctatcttctcttttgcagagaacaaagaagattacgtgttttgttcctaccttgatttcattttcagttcttttggacactgccttagttcagctcaagtgcatttgtgatttcacatgtaaaaaaaattacaaatgagcatcatattattcttgcttagtgttcacaatgctttggcgtccaggctatgttccccttcctttgcattaaaaaatgtgtaattttcatatgttagagctagaagggcaccaaagaagccatgaagatgagctttctgttaatctgttggtggcttgcatcatcattggatgatgcctactgaagcaaacgcaaaattctattataaagctaattcttaaacaatgtgcattacattcagctgctgtggccaccttagctgaggaagacatttctaagggatgtatggtccctgagggctctgtttaggcatcatatcatcaggaagtttatccttattcattcctactccttcctctctcccctcaactctgggatctatgttgttcaatgttgtactatcaaagaccgtattttattggcatttttttttccttttctttctctcctgctgtgagctccttgagggaaatttatgtttcccaggtctttgcatttctaaggctacaatcagaaagtgacacaaagtctacattaaaaaactttaatgaattataattatgaattataaccaaattaacaacactgaacctattattaatgatttaagatatgtagaatgttattgatatctttattcattgtgttccttttattgttgttttagggaatataaatatgtaagcgcttacttgtggtgttttatgactttgagcccccaaattttatattcattatcagatcctgaatgttcaactgccacaacttccatcacaggccaactcaggctgtcctagcaggctgctggatgccagtcacattaggctcaattcaggatgcagtatgtgctggagctggcacacacctgctcaaaggagctgatccttaaattttcaggaattatgtgagaagctgttaaacaatggatagcttgaaattggcaatggcaggagtatctataccaaagcaactggcaaatactacaaatcatatcactgcttctaatgagttacaaaggtgtgtgcttacatgctacccaaaaggaacttgaaggccttcatgtgaaaagatcatatgaataaacacaaagaaattagggaataatggccgggcaccgtggctcacgcctgtaatcccagcactttggaaggctgaggcgggcagatcacctgaggtcgggagttcaaggttagcctggccaacatggtgaaaccccatctctacaaaaaatacaaaaattagccgggtgtggtggcaggtgcctgtaatcccagcctacttgggaggctgagacaggagaatcacttgaacccgggaggtggaggttgcggtaagttgagatcatgccactgcactccagcctgggtaacagagcaagactccatctcaaaaacaaaaaaaaaaaaaaaaagaggaaattagggaataacaaactaaaccataatcaagccctaaatttaatataatcaagaaccaaaagttataacacaggtaagtgatacaggtatcagaaatgggagatgtcacagtcaaccaaaattgtggggggatcttcagtgaggagttggaaaggatgcaggaaagagaggagaggaatatcttcaggatcaggaaccagctgaacacagctgaacacatggagccaagcacctcacatgtgtataggggagagtaaagagggcaacacgaatgccacacagcatgcagccctcagggggagtccactgcacacacgcctggcttctgtggaacttggttactggaagtaccacatctgttgtcttggtccagctgtagcagagccatggatacttaagagtttgagaattaaggtgattgcgtagccggtgcctcctctatttcacctgtcttgcttattgtctatatcctctgtttaatcctcatctcgaccctttccatttatgattagaagttctcttcaaaaatatttctttaaaagctttgagggctatttccattttttgctatcttcatttttgttaacagctttccatggttttcctcataatatatgctttttttaaaaaatataacaaatccccataatccagattaaagctaaacaaacgcaccaggcattaagcaaatcacaaactccaggcttttttctgtaatacatgatacaaaacaatcagtaacactcaattccaggaccaacgagaagggagacattataaaaaatttaaaatgtctcaaaattctgtcactacagattggccttttctgaacatttcatataaatggaaccacacaatatgtgtctggtttcttttacttggcagattttttttttaggttcatctatgttgtagcatgcgtcagtagattgttcccttcctcattcacacccatcttcctcccttccttcctctctccctcccttcttctctctttccttcctttcttcctcccttccttcctctctccctcccttctctttccttcttttcttcctcccactctcctttcctccccatctttccttccttctttccttccttccttccttccttctattcttcctctatttctttcccagatagcattccattgtactaatgtactacattttgtttatccatttaccagttgtgacacaagttagggttgtttccactttagaaataactgtgaatcatgcttcagccaacattaatgtgctattctttggatagaaatatgtttttatttcctttgggtaaatagtggatatttgaaagtggaatcattggatcaaatggtcaacttaggttgacatttttaagaaactgccaaaccattctccaaaatggctgcaccaccttatattcccatcagcaagtgtgagggggtcttattcacatcctggccaacattccttgttgtctgtcttttttattataaccattgttctgagtgtttagtggtatctcactgttttgatttgcatttccctaacaacgactgatgttcatcgtcttttcatgcatttatgccatgctttctaataaagcattcatttcaaaatacattcatttgactattcgcaactgatcttttcttgtcactataaatccccaacttagaaaaaaactcttctgatcttaagagtattgtcttggtgtttataaccatcacctaggtgtcagcctgcatggattcttttagagaatggcacccaataattgtcctgtttctgtgtgctacccctttatgtgaacagccctgcagaggaagagcctgctggatgttcctgatggccctccagacctgctcttctctcttgtctcccctcatctgtgctctggaggctgactttgtaccaggatcccttgtgtctggcttcggatggagacacaggcaggtagagagcaacattgaagagcatttttcctctgctccctcactgtgggctgcagtttggaagtagccactgcctttccctgcctagtttttaattctggccaagcagaccctttccaggggctgaatacacttgaaagctcctaccaggagctccctcctctcataccttcagggttagagatggtaagggctgttttgggtgactggtcccttattcttctccacccactgatgggtcccttaaccttgtcaacccttctggagagagcttctttttaactatttatttatttaaatagaatagagatagcatctcactttgttgcccaggctgatctcgaactcctggactcaagtgatgcttccgccttggcctgctgagtagctaggactacgggcaagtgccaccatgcttggctaatttttaaattttttgtggagacagggtcttcctacttcctatgtgacctaggctggtcttgaactcttgggctcaagcaatcctcctgccttggcctctcaaaatgctgagaatacaggtatgagccactatgcccaatctggacagagcatctttaactctcatttttcaagtgtgtcttctcctttttgctgggactctgatacaggagataagcaaaactcctttgtgaaacctaagaccagcacttttatgcataaaacaaatggttagtgctaatgattaacttaaagtagtttcttcagacatatttgacacaacattacccactagtgcctgttcacctctgatcttgtagcactttgggcttttcacaaggacttgtcaccctctaccttgctttgtactcacttgcagtaggagacaattcccaccaccttcaccccaaacagcataaaaatgtaaaagttttttccagtttccctaaagtcatctgagcagctctccctaacccagaggagtgcaattactctaagaacctgtccatacaggcgttttttagtagatgttctttactcagattggagttatgaattgctaaccgtctaaattctctactgattgggagaatgagatgaggagtgaggggaagaaaggaataaagactcatctgaagcttcctaagagggccagcccaggagaaaacagccatgaggcagttcaaatctgcctagccaagccagggacaaggagctgggaatccccacgtgctgtaactgtcacaaatgccacactcaaatgcagatccctgggccactacagattcactgtattaatccattctcacactgctatgaagaaaccctgagactgggtaacttataaaggaaagaggtttaattgattcatggttctgcattgcttgggaggcctcaggaaacttacagtcatggtggaagacaaaggagaagaaggcatcttcctcatagggtggcaggacggagtgagtgtcaagcaaaggcggaaaagtcccttacagaccatcaaatctcttgagaactcagtatcacaagaacagcatgggggtaaccacccctatgattcaattacctcccatagggtccctcacaccacgtgggaattatgggaactacaattcaagatgagatttgggtggggatacagacaaaccatatcattatgcccctggcccctggaaaatctcatgtacccacatttcaaaaccaatcatgccttcagcattaactcagaagtccacagtccaaagtctcatctgagataaggcaggtctcttccacctatgagcctgtaaaatcaaaagcaggttagttacttcctagacaccgtgatggtacacgcattgagtaaagacagctgttccaagtgggagaaattggccaaaacaaaggggctgcaggccccatgctagtccaaaatccagcagggcagtcaaatcttaaagctccaaaatgatctcctttgactccatgtctcacatctaggtcatgctgatgcaagacgtgggtccccatggtcttgggcagctccacccctgtggctctgcagggtacaacctccctcctggctgctttcgtgggctggcactgagtgcctacaggttttccaggtgcacagtgcaagctgtcagtggatctaccattctgaggtctgaaggatggtggccttctcaaagctccactaggcaaggccccagtagggactctgtgtgggggctctgaacctacgtttcccttttgcgctaccctagcagggcttctccatgaaagccctgcccctgtagcagacttctgcctggacatccaggcatttccatacatcttctgaaatccacgcagagtttcccaaacctcaattcttgacttctgtgcactctcaggctgaacaccatgtggaagctgccaaaggttgaggctttaaccctgtaaagcaatggactgagctctacgttgacccctttcagccatggctggagtggctgggatgaaggacaagtccctaggctgcagacagcatgggaatcctgggcctggccaatgaaaccacttttcctcctaggcctccaggcctgtgatgggaagggctgccgtgaagacctcagacatgccctggaggcattttacccattgtcttggtaattaacattcagctcctccttacatatgcaaatttatgcagccagcttgattttctcctcagaaaacgggattttcttttctatcatgttgtcaagctgcgaattttccaaacttttatgctctacttccatcataaaacccaatgcttttaacagcacctgagtcatctcttgaatggtttgctacttagaaatttcttccgccagataccctaaatcatctctctcaagttcaaagttccacaaatatctcaggcaggagcaaaatgctgccagtctctttgctaaaacataacaagggtcatctttgctccagttcccaacaagttcctcatctccatctgagaccacctcagcctggatcttattgttcctatcactatcagcgtttttgtcagagccattcaacaagtctctagggagttccaaattttctcacattttactgtcttcttctgagccctccaaactattccaacctctgcctgttacccagttccaaagtcatttccacatgtttgggtatcttttcagcaataccccactctactggtcaatttactgtattagtccattttcatgctgccgataatgacatacctgagacttgccaatttacaaaagaaagaggtttaattggacttgcagttccatgtggctagggaagcctcacaatcatggcagaaggcaaggaggagcaagtcatgtcttacatggatggtggcaggcaaaaagagagcttgtggaggggaactcctctttttaaaaccatcagatctcatgagactcatccactatcacaagaacagcatgggaaagacctgcccccatgattcaatcacttcccaccaggtccctctcacaacatgtgggaattcaagatgagatctgggtgaagacacagccaaaccatatctgcaagcaaggagggatgtacctttagtagaattaaaccacttatttatgtgaaatactaccactgctatggtctgaatgtttgtgtcccccctagaaattcatatgttgaaatgaaatcaccactgtatttagaggtgggggcttcaagagttgattagatcatgagggcaaagcctcatgaatgagattagtgcccttataaaggaggcctgagggagattgcttgtcctttctgccatgtgaaaatacagcgagaaggaaccatctgtgaaccagagaatgaaacctcactggtgactaaatctgccagtgccttgatcttagtacttgccagcctccagaactctgagaaatacatttctattgtgtataagccactcagcccatgatattttcttatagccgcctgagtggactaaggcagtaatgtaaagattttactagcttttatagtaaaaatctagcttttctagtttgttcttcatatatatatatatatgagcattttcaaacagagtacttctggaagctgaacaacagtgtctcctgttaaaaaattcaaatcctcatccaaattgacatacatgtgctggcgcatatgttgtttatttctctgctgtttataccaaacttttcctgcaaacgcatccatcacacacacatgtggatacgcacaggcacacacatccaaatacactgcaggtaagacccactactactagtctcacagtttcacagtgatgttgggccaaaaacctgatccattattacttactgcggttcacggaagcagctttgtaaacctacataaagattcccccttccttgggaagccataaatgcaacgtttcactgagcagcatggaggcagggtgttaacctgctgtgtgactgctttcaaagagccagcactcctcagcagaagcctaatcatctctgtggatgtgctgtcctgggcctgcttcgataagtgctgtttatgtggctgtattttcaagatagcatggagggatgctaaacttggtatttgaaatctgtttttcctcacggcagcaacaagcctgcagcacagcgctaccagccagctagccaaccccacagccgcctgttgggcaaaggaaccctggaactcgttgaggttgcaggaacatacagaagatcatttctcctctttcattttcttgctgccttttctttcttaaaatcttaacgtcccaaaggaacaactgatgtgagtcagtatgtgttggcagggcaggatggtgtgtgtgtgtgtgtgtgtgtgtgtgtgtgtgtgtgttcgtgttcattcttcctgttcctgttttcccacctcagccttgggtgtcgatgaaactttttttttttttgagatggagtctcgcactgtcgcccaggctggaatgcagtggcacgatctcggctcacttccacttccgcctcctcagttcaagcgattctcctgcctcagcctcccgagtggctgggattacaggtgcctgccaccatgcccagctaattttttgtatttttagtagagacggggtttcaccatgttggccaggctggtctcgacctcctgcccctgtgattctcccgcttcagccacccaaagtgctgagattacagaaatgttttatatacctatttgctccaggcagagtttgaaggcagagacttatatcaattagagatccataaaagccagtgaggtgacatgaacaaaagcattcccaccaacactggaagtattcaagccagattttaaacatgagatttccactttaggataaaggttggatccgataactttgaagatcctctgccatttaaaaattctatgggccagacgtgatggttcacgtctgtaatcccagcactttgggagacagaggcaggaagatcacctgaggtcaggatttcaaagccagtttggccaaggttgtggcacatgcctgcaatcccagctactttgaggctgaggcacaagaatcacttgaacctgggaggtggaggttgcagtgagccgagatcatgctcctgcattctagcctgggcgacagagtgagactctgtccaaaataaacaaacaaataaataaattaaataataaatacaaaaataaatattctgtgatgccatgatcttactcccagtttaatgaacagttctgatggtgatgtttagagtgaaactcatagtttccttgaatattttcctactttgcatatttcccaagatgctttttccattttgaggaagatacaagataagatacttctcactgaaagttctcctttaaggggagaagcaatggcatctgaatctcaaagtttggaaaaaataaaccgttttttatctcttggctgaaggcaaagtgaagaagtaaccacagctcagctctgtggagagtgggggtggcagatgggaaggtgaaggaaggaaaagcaaacacagtcagccctccctccacactggcatccatgcatccacggattcaactaaccaaggaccaaaatatcccaaaaataagaagaaaaattaaaatgacagtacaatgaaaaaaaaatacaatctaataagacaatagagcacaacaactatttcaataacatttacattgtatgaggtattataagtaatctagagatgatttaaagtatatgggagtatgtgcccatatacacaatggcaaatcctatgccgttttatataagagacttgagcatctccagattttggtatctgaggggaatcctggaaccaattccctgcagatactgagaaacaacgctatgctctgggcagaagtacttccagaagagccacacgattgttcccctatccttgctcaacaaaatgccagcatcagaagaaacaatggaaaaacctgattctttcacaagagctgacctctgactataaaggatttagggacaagattcccaacctactctatatggcaaaggaagaaaataaaatgttatcttctttctccccagaggtcactcattgcttttcctctccaaaatatgcttgtcttagttcattcagcggctataacaaaataccatagactgagtgtcttatacacaacaggaatgtattgctcacagttctggaggctgggaagtccaagatcaaggtgacagtggatttagtgtctgctgaggacccactttctgattcatagatgatgctttcttgctgtgtgggcactaatctcattcataaaggctctaccttcagggcctaatcacctccccaagccccagcctcctaataccatcgtattgggggtgaggatttcaacatgtgaattttggggacgtagaaacactcggcttatagcagtgctctttttattttgccttactgatagctaaggtcactctgtgtgcacatttatttcacacttgaagcatccctggtgtttttaataatcacctccagcctgtcacgtgaaattaataacacacacacacgactccatttttcatcaaggccaccttccagaaagaaattactctttgactactcagagaaaggtgcagagattattataaaaatcaggagaggcaatgaataatatgaagaaattcagtgtcccaagttcttttcctcccacacttatttgtagccagtgtgatcattccttatgcacctaaactgcataatctaaattaattccaatgtgttgtagagtttcaccaccattacagtttgctgtgattagcaaaccttaacctagtgccttcatgtagaagtatgactattttcacagttttgtatgaatgtacttgctatatgaccttgggtaactcactttaccttctttgtcttggtcttttaccatctgtaaaatatagtatagtttttccttctccatattttatgattaagaaaaaatagaagatggttagaaaataataggaacacatgattcatgcaatcatgccaaaagtaccaggaaatcacatttcaacatataatttctatgcaggttatcagtaaagcacatctttaaatcactttcaatcaattcacaaggtaacagaattttgatttttttcccctttttaggtgcggattaaatatcccatctagattaagttttatatatatatatatatatatatatatatatatatatatgtaagaatcaatgcaatatcatataggtctcaaaatacgttattttcttactccttctttacattcttctcattaagtcatttttttcacttaacaaatattaattgagtggctactatattccaagaagtatgttaggcatcacaggctctcattttatctatatgcctggtgacaggatagctttgccttgactatatggtgttttcaaattttctttcttttctttttcttttttttttttttttttgagacggagtctcaccctgttgcccaggctggagtatagtgtgctatcttggctcattgcagtatctgcctcccggatacaagtcattctcctgcctcagcctcccaagtagctgagattacaggtgtgtgctacaatgcccagctaatttttataattttagaaaagacaaaattttgtcatgttggccaggccagtcttgaactactgacctcaagtgatccacccacctcggccttccaaagtgctgggattacaggcatgagccaccatgactggcctcagattttctattgacttcatttctatatagccagacagtaatgaattggttctgctgaaaactgtggtcaggataagttagaaacccttttgtttccttatgtatgtctttctaaatttctgctgagctacatcttaataccttattcccagacctcagctcagtgccccagtgcctgacacaaaataggctcaaataataattagttgaaatataaataatgatcataatgctaaatgacaaacagcccttctactactgggtgacctcgggcaagtcactgcatctgatgctctcttcattcataaaataatagacaaggctggtggttgctaaccagctgggtcaagactggtgttattgtaaagatgtgaaaatgcatatacattctataataagtcctacataaaaacagaatatactatttgtcatatatatatgtatgtgcgtatgcacaccacacataaaacaaataacagttttacatgcatgtagattactgtgtctaagaaaaccagtatcatttaaaagcactgtagagtttataacatcttttggctactatgtatttcgttaatgagcacatacaaaaatgtaaaattacaaccattttgacattctaaaacaccttcacactccaacagggcatcactggattaaatgatcttcaatgtcctatctagcacaaatatctgtggttccaattcaacagaaagcagaaaatatttctcaagtgttagctatatacacagcaaacaaccaagtggaaagcagaaaatacagccaatgaactctacaagtagaaaatgtgagcattttctctttttttttgagatgaagtcttgctcttgttgcccaggctggagtgcagtggcgcaatctcggctcactgcaacctccacctctcaggttcaggtgattctcctgccccagtatcccgaatagttgagattacaggcatgtgccaccacgcccagataatgtttttgcatttttgtattttttgtagagacgggctggtctcaaactcctgagctcaggtgatctacccaccttgacctcccaaagtgctgggattacaggcatgagccactgcacccagcctcattttcttttttactaaagctgctgccatgactggctttatcatgccactccccctcccctgtccccaaggtacactggcatggtcctgctctccagagtaagttctacacataaatgacccttttccctttgtccagtaaatggctgggccatgtcctttaaaccagcagtagctgttaactcttggttaaccacaccccatacccacaatgtcaagcaataaatgtttttgggagataactaaagaggctgctggaaacatttgctgcatgttcaatagtgactgacagtggagaggagggagtggtgggcatttcttttatttttatattttgagatggaatcttgctctgtcgcccaggctggagtgtagtggtgggatctcagctcactgcaacctccacctccagggttcacatgattctcctgcctcagcctcccgagtagctgggattacgggtgtgtgccaccatgcccggctaattttttgtattagtagagacagggtttcaccatgttggctaggctggtcttgaactcctgacctcaagtgaactgcctgcctcggcttcccaagataggcatttcataagaatcatacaacctgtcctccctgtacctggggcatacacagaccaagggtacaatgcgtatgagctaaagagatcctggctgcaacgtatttgagcaaaaaaataataatcatttgtattatacaatgaagagagatgatgaaatggttgtgacttatttgagaatataaactatagtgatcaataaaatcacatttggtgcggtatttaacccatttatagagatgtatattttcactctatgttaatttgcagggacatttgagaggaaatgtctgtataataaaaacattaaaatagaaatatttcaatctcagttttgcctaaggccccaagtccttgtttatcaggatttgaaaacaagataaccagaaaaaaaaactttatgactctgagtccctcagtcatcttgaggatataaatctgatatgtatattaagggttcaaaatggtaggattagaaattaaaataaggcttatttggataaattgttctataaaccccctcccatagggagtgtgggggagtttgcctctcacctcaatccaagagaaaggttttagacatcttgatatgtagcccctggggtttggaaactgtattagtcagtgttctccaaagagactgaatcaatagaatacagatatagatgtagatacagatagatgtgagggaatttattaggggaatggagtcacacaattatggaggctgagacatcccacataggccttctgcaaactggagaaccagagaagccaggagagtggctcagtccaagtccgaaggcctgagaatcaaggaagttaatggtgtagctctgtctgaggccaaaggcacaagaacccagagggccactgttgcaagccctggagtccaaaggcgggaaaacctggaatccggatgtccaaggccaggagaagaagggcatcccagctccaaaagagaaggtgagcaagagtctgccccctccttccaccattctttttctatctgggcccctagctgtttgcacggtgtctgtcaacatcagggtggatcttccccactcagtccactggcgcacatgctagtctcctgcatacacaccctaacagtcgtgcccagaaacaatgtttcaccagccatctaggcatccctcaatctagtcaagttgacacctaaaattagctatcacgcagactgatgtctgatttgtgctataacatctatggaaagagagacggtagcggatacgcagttctgattgtggcctgaagagagggcaacaacctgtccccacagagagtcagagcaaagaaagcccaagttccttagactctgctcaggaagcctgtccagccatgcaagaagactccagcagaaggaaaatgaaggggtgccacctgcatgcagcgggtgaagggctgaagaagggatcctaaacaaccaggagaggagaaacactcaactctgtcaaagacactgcagataggagatgtcaagtgaactgacaggatggattaggaactcttttttttttttttttttttttactttaagttctgggttacatgtgcagaacgtgcagttttgttacataggtatacacatgccatgggtttgctgcacccatcaacccatcacctgcaacaccaggctgccacaacacttgggttacacctaatgaggtgactccatttccattgtattgctattctggttagtgagaagacacactataggataaagtttgcattagaagagccaggaaaatatgaagtagaattcctctttaattaatgttaaagaacttaatcacagagggagaaataaatgttcacattggcacccatcgatatcatgaatggaatacaagctccatggtaccatgtgcttcctctcttgtaggatatggactgagccaccttggcaaactatgcccatggtatattcacttcatcaacaaagctagtccagaacattctatgcatttgcttcttataacctgattcttggccacttaagcagcattctcaatgcttccaatgagtgaaaatgaaaaaaagaggacaaaataagccaataattccagctcattagcagccaaaaaaaaaaaaaaagatctttgggcaagccaaagttctaaggggaaagggggaataacgacctaaagaccagtgccacgtatgtttgatactcttaactgtaactctggaacaacaacaacaaaaaccccatccaggtttaaaaatatgtgtaaaacaccatattataatataatctcatgtttattattttaaagtaggaaaatgcagatagtgtgtcttttgcatcactgttgaaaatacgatcattcattgaagacagagcagtggtatcctagttaaaactctttcaagttattcaacaataattgggagcttcatcaatagcaattgctattttccatcactgaatgcaactcattcctgaagcccattgaacactccagaatattgtgcaggcgtaggtcttgctgactcagttgtagccagcaatatttagtcatgctcctcgtcaggtacttctggctctctatgatgtggagaaatggtaggaggatgtcatttggacccctgtgttcaatggagcaatgtggttggttctggccaatgagctgtgagtggaagagacctgccgcttctgccgagcatttcgtatatgtgtgggtgtgagtatactctccttctcctcccatggtggccagcaacgttccaggggctgagccccctgagaagcaatgcccccatttgccagagtcagccatgtagtatgagtgaggaagaaaactttgtcttaagcccatgagattcaggggttatttgttactacctgttaacctcccctgactgatacaaaggtcttattgtctacctccttactgatattgactgatcaggtcacttactgaatatgcctggactgcaactcagtgcccatttttattttaaagatcgatgagttgttttatgattggaacttggggtaatacaaataatacatttcccatacgagcatcactaagagtaaacattgactgacaatgaatagtcattgttgatttgcacataaacccacaggtagattttgttcattttgtaagatagaaattagatgcatttgtcaggctgatgactgagggtgggagcatcatggagagtcacattagaagtggtgacacctgccatgagggcacagcatttgtgcaggtactgtgagaccaaatgcactgccttcaagctggatgcaatgtaatcaatccactttaacatgagtaatcattgctgagcatttaacatgagaatcatattataacacatattatgaggcgctgaacaatttggtgaagaagagagttatacaagttatatcgatgagttcagatgatttgaaaaaaaaaaagtggttagatttacaaaaggcaaggaaggaaaatgtgtaaagggaaatactctgtgctgctcctccagaaagacattccccaacagaggggggcttgccccagtgcggtaccacctgtgttggggcaggtaagcccacctctttgggtgttcagcattggataacacatttacctgcagatctaaaccacatcccgcagtgtagactttttcagtaataatggtggaaacctgatctccttggccttactactttgttctatgtttcaatttgtccagaatagggacagagaagcaagtgctgttgattggtctcttcaaatacagcaagggaaagtcctaatggagaagccagtcttaggctgagatgggaaggaaggaagaaatggggtttgaacgtgaggaggatgggaagtattccaggatacagtactatggcacaaaatcaaggactaaatgcttatctgtctattttttgagttctgtaaagtgctttcacatacatgataaaaatgtgtaatggcactgatggtcagtgtaaatcctgtgctctcttctgtatccaaacactggcagccctggactcctagtgaaggagacagacatgtgtcctgtttttgtggcgagattctagtggtgaagttagacaggaagcaagtagtacgtatataaagtattttcagatactgattagtgccatgaatgaaaataagggagggtaaggagacaggatagtggaggctcgctcttctgggcagttggttaggtctggtctgtgaagatgggtctttgatcagagtcctaactgcaaggagacaaagagccccaaggagaaacaggaagggaagaatctcaggcagcaagaaaggcaatagtacagaccctgaggggaaacgtgtttggctgtggaggaggccagtgtggccctaggggatcaggaggggtgagtccaggggaagaaagccataacatgcaagtagcagctggaggaggaccccaatgtccaaggtcaggggccctgaaatgaaagaaaaggccagtgaaagccaggactgtgcccagagaaggcgaagtgattagaacactcttgaaaatgaatctgctactgggttagggtgtctccccgaatgtcgggaaaactggccagaggtcattaaaatattgcaggtgcgagataattagaacctagccttgggcagttattacaggtgctaaaatctgaaaactcaaactgaggaaaattggcagagctgggagacttattggatgacaagggcaaagaggagagagaaatggcagacaattcagggtcactggctgactttcactgtcagtgatggcagacgtgggaggggaggccatctaacaaatgctcacgtctagggcttatgtagtcaacggtgagagcaacctgcaaaaaaataaaaaataaaaatactgttccaagagccattttttaaaaaaagaatgtcacgcagactgaaaaagaaaatcaaaataaaatcaagaaaagggattgtattacaaactcactattctcaagataaactgaaaaaggcaaatttcatacttagtaatgagaacaaaataaacactttcaattgattaatattgcaatacaatcattttgattatgtgtctttattttatttgttattttttcagtcagggtctcactgtcttgcctatgctggagtgcagtggcaacctctgcctcccagtccaagcaattctcccacctcagcttcccaagtagctgggattacaggtgcataccccgaggcccagctaatttttgtattttttggtagatatgggtttcaccatgttggccaggctggtgaactcctgacctcaagtgatctcccctcctctgcctcccaaagtgttgggattacaggcgtgagccacctcacctggccagattatgtgtctttaaaaaataaaaatgaagacatgcataaattagtatagtagaaggaaaaaagagatacgacaccttttatcttttttagggatcaatgaaaggccaagagatttgagaactgtaagaaagccctgagaagcacattgttcaaaatttatgctcacttgaaaaaaagaaaaaaaaaaaaaaaaaggaaatgacctaggctgttacaaaagttaaacccaaattgagcaccttttaaataaggttgtcaaaggttaagtatgtttgaggtaaaattatttccccagtctcaaaatgaaatttccagtagactttagaaaaaaaaaatatggaaaacaaacatacatggagaaactgcattttacaactgaacactgggtttcaagtagagtgatttttaaaaatctcatatttagatactgtctggttttaaaaataggccaaatggatcataggctgagaatcagaaatccttcttttgggttgtctcttctccgtaagcctcaagtacttcttagtcctttcttcatgactagataaaattatagtaactaccacagggattatgattcctagtcaaacatcaatcatagtcctacacacaaatgatgtcaagtgctaggcactgtctaggttctataatattagagttcctaaatttacacacgcacgcacacacacacacacacacacacctgagatagaggatagaaagataaatgatgatagatagatagatagatagatagatagatagatagatacatatacatagacagacagacagaaagatagatgctaggctgggagtggtggctcacacttgtaatttcagtcctttaggagcctgaagctggaggattgcttgagcccaggagttcaggagttcaagaccacctgggcaacaaagcaaggctctgtctctatgaaacacaaacaaacaaaaaattagctggacatggtaacgcacacttgtgctcccagatactaggaaggctgaggcaagaggatcacaggagcccaggaggtcaaggctgcagtgagccatgattgtgccactgcactccagcctgggcaacagagagagactctgtctcaaaaaaaagaaaaaaaagaaagatagatgctagatagatgatagatggaaaggggaaggaaagggaaaggggagaggaggggaggggagacgaggggaggggaggggaggggaaatcccttcaccgaagacttgtaggtcaggtctcaaagagcagccagcagacagccttcagctgtcaactacatcagggattgacccagctgcagagaactgcctcacacaaggtcacaccccttcctgggtgactcacaatcaactgacacaatcaataaaacctgtctgtcttgagccaagttggcacaactctgaagatccattctgattgtggagttccctgtgaggtctgtgtggctgggcctgcattgtagctcaatttctccccctcctcactactgtctcctctcttcccttccagatgtcattaccaaggatcctttttaattagcatcctatattccaaactctaaccacagtctgcttcctgtacttgcatatattcattacatacatatgtgtgagtgtacatatatgttttaaaaatccctagcaagagtaagtacgttatttggtcagtcagctgttaaaacttccactttctccagttgtctggtggaattaaaaaaaaaaaaagactttcacttttattagtgcaattcatatcagtgtgccactggtagctcttggaagagaaggaagagagagctaatatggaacctggagacaagttccactctgctcctgctgaatgcccttctcctttgcttctacctacctccagaagtgctggccattgtcagctcctgaaaaggctgatgctctgacctgtttcagtgaacggggagaggacttgaggctgggaaacctttggaataggcaaggggtccccctacataggcttccctccatgactcatagtgtgttccttggttcgctccctgtggtcaaccacctgctgcaaaaagtcgttcactgctggtgtgagaatcattgtcacctacactcaagtaaaaatgtgtatcaaaggaacagatgcttctcttccatgcaacctgaatatagatctatcaggcaaattcagacagctgttctagatgcagagaccatcatatctgctaggggtcagcaaacactgaccatggctcaaatctggcctgccatcagattttgttgggcccgggagtgaagaatgttttcaggcttttcagtggttgaaaaaaataaaataaaaagcataatatttcataatatgtgaaaattatataaaatctaatttgtagtgtccataaataaacttttttcttttcttttcttttctttttttttttttttgatactgagtctcgctctgttgcccaggctggagtgcagtggtgcgatctgggctcactgcaagctccacctcccggtcacgccattctcctgcctcagcctcccgagtaggtgtgactacaggcgcccgccaccacgcctggctaatttttttttttaatttttagtagagacagggtttcaccgtgttagccaggatggtctcatctcctgaccttatgatccgcccgcctcagtctcccaaagtgctggaattacaggtgtgagccaccacgcctgtccccataaataaacttttattaggacacagccatgctaattcatttacatattgtctatagctgcttttgatccacaatagcatagttgggaagttgtgacagatacctgaaagccaaatatgtttactatctggccctttgcagaaaaactttgccaaccacagagctatgcgatttaggattatacaacacaatatcacacatttgcttattggtgaacatccaatgggtggatattcacacagatatagacttgttacctgtacatgtctgtaagtatctggcctctcataaaacactaaacaccttccacagaagtgcacaatgatgtagagaccccacgttatgctcaaacccaagcgctatctttcttcacatctttttagttcaaaatatctgccttaaaacagaactggaaaaacaacatttgtcaagtaagtgcagccgtgttaatgttaaatagatgaatgcatggatggatcttttaacatacaagcaatggagaagatatgccagcaatgataatacttgtgttagtgtgaagggtattttagatctgccccaaactcaggtagaaaaagtttccctgaccttttccctaccagtttagaattttaattcatcccagagagtcagtggctttgacacaatagcacttactcttcagatgcctaaaattttatggtcaaaaatatcaaaagattagaaatgtgattttcaatcccaaaagccacattgaagttcaattaaacaaaaatgcctggggttttcatatgcactgaaaatcataaaaatcaattttattacaaatctacccatgaaaccgtctatctgtctctccatccatcaatttatttctgcaatatgtctcaaaatagcacccaagagtttgtgccaattcttatttttcaagatatatgagctttttcaagttcacaagctccataaacttcacaaactccatatggtgttcacaaaggaataataaatgttttttatcttttacattgtttatgaacacataattcatttttactatatcaattgcttgcctaagaagttacaatgcttccttttctgcttattctggcttacaagcctttcagaattgaatcttacctgatctgttcaatattacattctacattacacacccaatttcactgtatctcacccacctgtcttcctacacactaaagcccttactcctcctaatcgccatgttttcattatctccatgtcccttttatgtgttgttctttctacaaagaaaccccttttctcctctttttgaaaaacacctacttatccttctagaacaacctaaatgtaggaactttccaaattctccagggaaatatagcccttccttccttccatccatccatccacccacccactcacctactcactaatttatcccttactgaacaaacatactgagcatctattagatgctcaaaaatgtataacaaataagctatttctgcttggtttataaggacactgagatatcagcaaagtgttatgggaccgaagaagaagaaaatagaagaaagacatcaaagtcaaactggaagtaggacagtttggaaagcatttcccagaagaggtgatactgagttaagtatacacaggacaagaattatgcagccaggtggatgagggatgggaagaggagaaagggagagggtgttctaagccaaaaacacagcaggtaagaaactgagtcaccactaggaaagttaaatcaatatggcagaaagaaaacctgctccttgggtcatttcatcatgcgtttggtagagcacttacaactttatattaagtaatatgggcttgaggttctgctttagataatatggacttgaggttcttctaccttttattacctgtcagaaatagggttttaatccctgggaggtgaagcttgcagtgagccaagatagcaccacggcactatagcctgggtgacagagcgagactccatctcaaaaaaaaaaaaaaaaaaaagaaaaagaaaaagaaaaagaaatagggttttcatctggaaatatttggggctaagtgttgtcctgaaaggaactttggaaaagaaatattccattacacttgctttgtcatcttgtgatacagactcagcccatggatcaacaaaatgccttcattctcaacagtccaaagagctctgggtaggatctcaccttccttacaaaattcatgtcagatgttgaataatagacattattctgttcctcttccaagtgagagacaatgagtggctcatcccctgaacggtgtgtggaataaggtgaaacatgtagcaatcaagaaactggactcatcccctgaacggtgtgtggaataaggtgaaacacgtagcaatcaagaactggactcatcccctgaacggtgtgtggaataaggtgaaacacgtagcagtctagaactggctgcagaatatatgtttggattttgtaactttcatgctcccaaaactcagagtcatttttctacattggctctttccctgtattatcaattgtacccttcacataacaactgtttcctaatggcaaccaatcaattcagaattcaaatggcgattcgccagtttgatatctacgttgccctggggttatggaagaagctgcaaattttggggtactgttccagcttattaaatctttttattgaaatttgattcatcttttcctgaccttatcaaaccatcccggccttgtcatctacagcaggactttgcaaagtggactcctgtcgcttgctgcattttactggtgtgaaatcagaaggagtatggtggataatgcattttgaatccggttagacattaattattaggttggggcaaaagtgatagttttttttgccattaaaaaaccatgatcacttttgccccaacctaataacacccaaaccacctgtagaaatgatttaagaaatcttcaactcaaatgccttctttcaggaggagttttaaaatagaaattacatcattccaaggttgtgtctgcatatgcagttgtatcaaaaaacttaaatgtaatttttgagggaactaagccaggagaaagggccatagtgatgaatgtatccaaaagtagccatcagagaatccgtgagttcttacactgacacaggaagaccactgtgtttgacagatgcaaaatttccattcagatctggtcagcactcttcacctaactggtgtttttaagagataattaaaactgtttgcacaatggcacagtccatgacacattaataataataactaataacacattaataataataactaataataactaatggcacagtccatgacacattaataataactaatatataataattatattattataactaataactaataataactaatataacgaattatattaatgatagtaactaataatgtgaccatgacacattaataataactaatattaataataataactaatattcaatttaattctcatttctataagtgccaggaaatttgctaacattgtatgtatacatgtaatacatgtacattacatctcatgtaatcataactgttttattgcttttttttttttttttgagacagagtctcactctgttgctcaggctggagtgcaatggcaccacctcggctcactgcaacctccacctcccaggttcaagcgattctcctgcctcagccacccgagtagctgggattacaggcgcctgctaccacgcctggctaatttttgtatttttagtagagatgagtttcatcaccttggtcaggctggtctcgaactcctgacctcaggtgatccacctgcctcggcctcccaaagtgctgggattacaggcttgagccaccgtgcccggccaactgttctattgttaaagcaggtagctaggcagacgtgagcaggtcaggagaggacccccaacccctccccaggaatgtcagctgaccactaggtaatggtcaggaggttgttaaactatttctctaaaataataattgattgcagctggtaccaaagaaagaccgtctcccaatagatataaaacacctgaaactggtgatcagcttccaaataagatctcagaagttgggcgagcacgctaagcatgtgcactaagaggcaaaatggcggcgtttaactggtatatgagcttcctccaggaacgctctgctggtaagggaaaaacgcctcaagtgagcatgcacacaacttcagtaaacacactgcgcacgcagccccttccaagtgctgacaggccactgtacatgcggacagcccgctccgaaggaagaatcaggggagaagaaatgcaagcccaaaaaccctgccaaggtataaaaccccagtcaaggaccggatggggcactggatctctcaagtcacccacttggtcctctggcaagtgtattttgcttccttttgttcctgccctaaagctttttaaacaactctgactcctgctctaaaacttgcctgtatctctcccgctgccttaaacccacttctaccccttggccaaattctttcctttgaagaggcaaggatcgagtttctgcagacccatacaggttctccactggtcacaccatcaagtaagcattatcattattattcccattttacagaagggaaaactgagtcttaaagttataagctttcttccccgagttcacacagctaataaatacaagaggagaatttgaagtaaggcagtctgactctggttctaaaccaagtttatagtctattgatagctgttgccattgttaaagcccatgtcatatttagaatatagttccagagttggcacattggaaatgacaatattactttaaaaaatgtgttgaagatgggagttaaattgttttggaatttgccactacataaactatataataggggcagatatgagcagtgtcagattaagcagagacaggctccgtggccaggaaggcataaccatttgcggcttaacacagccaaaaggtcagaaagggggttcattcgagggagccaggaaacggggcctgaagcaagacttggcagtgacctcctaactttatcagtgaaaagaaggtgatttcactcagcctgctcagtcctagggctcagtagctttttgtggagatgactgcatagcacccctcttttcaaatacagggtggaggaaatcaaaatatctcaaaacatccttctcggacatattttgagatggatgttcagagggccagcagatagaagtagccatgcaaagctgtcttttgtcggggagatacacatctgcagagaaaatctgcattgatgtagccaggctttctccaagggcctcccctgtcctcttccagatctaggaaagattaaccgactgtcgacacctttgaaggtctgaaagaaacatttaccatctattctctctgagggcggctacctgtgagatttcatctacataacaagtgatctttgctagccagggctcctcttctctccctcccataatcacaacctgttttgccacaatccaagcccccattctttctgcaacctcaagatggtacataagcttctgaaccccactggggagttgggataatcactctgcagttttcccccatgcacatgttatctatgaacagaaggacaagttagttaccctctcctcacaacccacacctcaccaacaagcaagccatcaattttgcagcagactgaagctggaagtcctctaattcagttccactctgacactctcttcctggagatagcgtcagatcccacaggttgagggctcagtccccaagaatgccccttgcttctgacgcgaattacaagtcccagtttatttcacctgtgcttctgacagaccagctggaaattagagatcccatgatcccctgcttgagttcaattaatttgctagagtggctttctgaacctagggaacacttatgcttactggtttattataaaggatattacaaaggatacaggtgaagagatgcatagggtgaggtatggaggaagggttgtggagcttccatgaccttcctgaatggctccaccctccaggaactgccacatgttcagctatccagaagctctcagaaccctatcctcttttttttttttttaagcttcattatgtaagcatgattgactaaacctttggccattggtggtcaacttaaccttcagcccctttcccctccttggaagttgaggggtagggctgaaagtcccagccctccaatcatgcattggtcttttcagcgtccggtccccatcctgaagccacctagggactgccagccatcagccaactcattagcatacaaaaagacatcacttcggagattctaaggattttaggagttgtatgttaggaaatgggatcaaagaccaaatatatattctacaatatcacaggagtccttgaccaaactagataggccaggtctggcagactgttgctagctttacctcatctttcaatttttctagagaagtcagatatctgaacattaatgtgaaattttccatgtttaaaaaatactgcgcaggccaacaaaacacatcccctactcagattctgcgcatgggccaccgatttgcaagtggcatgtgctcatatgtacttcagatcaatacattctaataccgaggcaacttttttctcagtaatctaaatttagggaactattctcagaattgcccataggtcttatataatctgaacatcacaagagaactcaaatgactataaccataatcgtagaactgaactgtgtcattcacatgctgtcatatccatcacatttccaactcattccaagcaaatcctcagctgatcctgtgtaagggctcactccttccctatgtgcgttctcatcatttgatgaacttaactttggcaaggagctagaagacttagctcttgacaccacagcatgagatgggaactaaattggtatatgacttgattcttgggcacagcagtttatgtttttaaccaacactcattccagaagtagactacataagataagtagcatacacacatatgcatttcttaaactaccgatttaataattcattccccaaatacttaatgattgcataccatgttacagaatctatgctaggggtcgagcacacaatatttagacacatgcacacgtatgtttattgcagcactattcacaatagcaaagacttggaaccaacccaaatgtccaacaatgatagactggattaagaaaatgtggcacatatacacatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggcgattgttgtggggtagggggaggggggagggatagcattgggagatatacctaatgctagatgacgagttagtgggtgcagcacatcagcatggcacatgtatacatatgtaactaacctgaacattgtgcacatgtaccctaaaacttaaagtataataataataaaaaaaaaaaaaaaccagccctgaaaaaaaaaaagaaagaaaaagacaacctggtaccaaacctcaaatgcttttacccaacagcagtagttctcaaaatttggcccccagatcagaagcatctgcatcggccactgagaaattgttagcaacacaaattcgtaggccccgcctcagaacctcagatctactgaatctgagagtctgggaaccaggctcagcaatctgcgttgtaataagccctccaggtgattccgatgcaagctcatgtctgagaagctcatgtctggagaacatctgggggtggggaacaggggtagaattcaaataaaaaacacaggagactgatttacacatagtggccagaaaagcatctcttaatagatgacagttgaacctgaaaaatgaaatggagtcagtccttgaaggataggaagaagaaaacaggatgagtggggaaaacattttagggagaagcggcacacagcagtgaccttgtgcagacaaagaagtcagcgtatgcaaagaactgatcaaaagaccctctggctggagcccagcaaatgagaagagaatgtaataagataagattgaatcaatgactccggagtagatctgaggtgcagagatggcaggaagcgaaaggatgaccctgacggacaagagctggggctgagaatggggaaaagtttatgatttcagaagggagggagtcactctgtagctgaccaaggctgagataggcagggccagagattttgggtgtaaaaacttcctagaaagtgcctttagcgataattatttgcagacagaattatcgtgaataagtaatcagaagacttctgagtttttgaaagactgtactatccaataaaccacatttccaagcttcaagcccctgccagtcttcagattgcaagagaaccctgggccccaaagcttatgctgactatgcagtgccaaaagcagcatattctgcaatgtccttttttgggtaaggtcatgaataatgtgctaagaacaatctcttgaagggatgagacagagggcacaaagagagtgaacaatggaattccttccagaaggcagaatcaggccccatggagtaaaccccatattctctactgccagcgatgggaatctgttattcttgaccagtaaaatgtgttaattgctatgaaatactttctggcctgtgtttcccatcctcttcctctccaaatgagagtttttattacagtttcctgtgccactgctccattgaatatggggtaatacagggcatggataacctgtcttttagtttgtcagtcaccaaaataagaaaagcaatacacagacccgggggagaggacgtgaatgacacaggcattctggacttcagttcagatgcagtaactggttagatcttcgggcttgcctccttttgggagcaggtgagtgtgttatgtgtggggtgaagaatacatacaaatacgtgtttggccgggggcagactgaagcagattgttggatttcctccagtattcgttcttctcatctttcaatgtaaataaagtcaccaacttctgactgagcatacgccacctgggataaatgccaaatttcccagcctgccttgagatccggtggggtcatgtgactaagatctggccaatgtggtaaaaacgaatgtgtcatgtggcatcaaccaggagatttccacagggacagctgtactctttggtcctcctctttttttttttttcttgagacgagtctcgccctgtcacccaggctggagggcaatggcgcaatctcggctcactgcaacctccacctccttggttcaagcgattctcatgcctcagcctcatgagtagctgggattacaggtgcacaccaccacgcccggctaattttttgcatttttagtagagacggggtttcatcatgttggccaggcttgtctcaatctcctgacctcatgatcctcccgcctcagcctcccaaagtactgggattacagggatgaaccaccacgcccggcctgatccttcttttatatttccccttcctctttcctgctgtcagttacccaaatattacctcggacaaagagccaggtctgtactcctggggtggtgtggtcatggaagctggaaggggcaactgaaaacatcttggagcaaagccttcagactgcatgtcttcaagactcttgtgaaaaaaatgaaaactgtttatttggaatttctgttatttgcaaatgaacttatcttaaccaatatggactcttggccactaaaagtagcttaaattttactccaaatgcactagcaacccatgagagggtttcaagcattgagcacaataggctctgctgtgttacaatacttttaactctgcaaggaatgatgagaaagaggatgggggtataggccatgtggaaaatggcaccagcaaatatggtggattcaggagggataaaggggggacatttttgataggttttagaggtaacatagtattttttgataaatttgatgagattgaagagaaaaataaaatattatctatatctcatggataatacaagtgatacttatttttatcaagttagttgacaaatagaaatttctctgggaaattggaaatatatgcatggcagatactcactagggtggctcccatgattcccgccccagcatcagtatctttgtgcaatctcctcccctcgagtgtgtgctggacctgtggcctgctttcaacaagagaatatggcaaacttgatggggttatcactcccctgactacgttatgttatatcacaaaggttgggggattttgcagattttgttcgagcccctatagagttaataaaaaggaatatatatactgcatgggtctgacctaatcaggccctttaaaaagcatctttctctctctctctgtctctctctctctctccccccacctccccacctccccaacacacacacatagagagagcgagagagagagaactaggccaagagcccaatgagcagaggtagaagtcagagactgcaggcagcaattactctctctccattgctggtttggaggaagcaggccaccatgacttctacagctgcaaggagatgaactgtgcccataacctgaagaagctaggaagtggatcgttcctctcagagccttcacataagaatgccacctggttgacatcttcatttcagccttgtgagaccctaaacagaggacataaactgtccccagactcctgacctcctgactcacaaaaactgtgaagtaataaatgggtgtttttttaagtcactaaaaagtttgtagtaatttgttctgcagcaataggatactatacatacatacatttatacacacatgtaatatatatgttatatacattaacatgtcaatgtagaaaatgatatacatgtatctatatgtgtatgttccttaagtttatcctccttaagaaaatcaagtccttttttcatccacaaatgcctgtgaatgtgacaatgtatgtctatgtatgtgtgtttctttttttttttttttttttttttttgagacagagtctcactctgtctcccaggctggagtgcagtggcgcgatcttgggtcactgcaaccactccctcctgggtgcaagcaattctctgcctcagcctcccaagtagctgggattacaggcacccaccaccacacccggctaatttttttgtatttttagtagagacggggtttcaccatcttggccaggctggtcttgaactcctgaccttgtgatccacctgcctcggcctcccaaagtgctgggattacaggcgtgaaccacccgcacctggcctgtatatgtgtttctttaggctataattgaaaacagaatattgctactttgactttactgatggctagtataagatgaggtcatttcttagttataaaattaggaatttacctattaaacagaagaaattcaattgtgtttcatatatgtacttgtttctgtgtaagaaatcgattatgtttcttcctatgtatgttcgtatgcgtgtgtgagtgcatttataacaagcatcctcaatgcttaggagggttctcaaccagccaatttctcacattacctcaactgagaacagatagctgcagcaataaaagaatatactcagatctcggtgggtatcttagagacatccctgatgaaatctcacaatgactctgggatagctaccctgggctcccttttcagaagggccaccgtccatcagcatggtgggggatcactatggccattgactaacagagacagcagcaatctcatattctgcttttggaattctcttgacatgctaattccatattatcaaatatatcacgggtatcatttagacttttctgtacaatgtgttccagtcaccactccgacttttgctttcaattatttcccaaagatttgaaataacagataaacttaattttcatttatatgcctttctctactgcctacttccttttatttgtcaaatgtatgataactctttaaaattaaaaaaatacatattttacaagtaaaatctgcatgaatcaaccttgagttttataattaggtgcaatcatgatttaatgtgtttagattctagacaacttctcaatcatcctaaagagatacacattagccttatacggagacagaaacagagaaagaaggcctgcaaatctcttacgcatttatttttataaacatatattataaacttactatgtatctgaggcaccgtggtggggtgtatagtctatgacctcaaggctaccatgttgtcatggaagaggcagactggcagagcaatgatgcaattacaaataagagctgatgtgcaaaaggctgatggagatctggagggagcagtgcggaaagtgacttgctgggcagtaggaaagatttcactctatttttgtagcacaaacacaaaatcaccccaattcctggggtaaaaattatttatgttgcattttaggtaaaccaatagtattcttaacagtctttaatttctgttttcttctttaaactctactgcatccaagcctacagaggactcaatagtagaagcaataatatcatcattttaggatagtgagacgtgattggtgataggagtaatctaattagacaagcaaaacactctggagtcatttaatatttcagtgtaggagctatcagtcctataaactttaatcatcaggaaaaaaattattgctttgctgcacactttgtgataatagccatgagtcattaaagtaaggttcaattatgttcattatgttctatttaaaacggaaagaaacataccatatttagaaatctttctgtccaatgagttatctttaaatactacctaaataggtgaccgtttcaaaatttcattcatcaaatatgtcatttgttcataatgttggaaaaataaaatgccaacatactaaaaaaaaatcacattacatttaaatagttgatagtggtctctaaagttttttcctaatttctcagcataattccataaggcagacattgtttccattgtgccactgaagcaactgacacagtcacttaaccttagtcatgtaagtcacccagttcttttaactcctataaatgctctttcatttatccatctattaattcaatagactcatttattgagcattcatatgacccacgtttcataaaataaaatggcagacagtttaggtaatcctgtaaatctacaattataacatgattcaaaatttttctggaggtggattttctagtaacaagtgattcctagaggactttaactcactttacaatgaaatactacctgccatttaattacaccagggaatacttcgggtattttgagagatagatggattaagtcggtaccctatccgtgagtgacacaggtccacgaatgggaagaactccagctttctctgtatgttcctcacataaccagatactttaaatgactttgtaattttttgttcatctctcagttcagcaggtgaaaaaacaaaacaaaacaaaaaaatcaaatcagtcagagctaacgcatcctgtggagaaacaaaaggactgactctgtttctttcttcaatgggctgtttgatattgtgtagatttagtgtctgtgctcttcttaaaaaattccacttaacgacccaaaaagaagagcattactttcacaatttaataaatggaaaactgtggaatagaaaggttaagtgagctgattatgctcagacaagtccttagcaacatagcatttctctgccagagattacatgagaagctgcctttccatgattcccattgtttatgcagtcattctgtgttgtcaaggcactttttgatttttgtcttctgtttcctaattctgccaagttattctttttttaaaaaaggcacagcacacgtggcaatctaaaatccagagtttttcttggcatcactgattatgcttttggatgaatgaacacaccgacttggatgaggaaaatgcaaaagaaaaatagtaaaatagtaaaataagagaagtattatgttcaatatttgaaataattacagtcactcaggaaaaaaataagagcatcttaaaatccattagctaacaggactaggagggcaaagaacagcatgaaacagctattggaatttataccttttttttaaactcacagactaaaccaagataccattcatagtttaaggctagggggatagcaaattggcctcacattagaaagaattgtccaggctttgaattgatagcccaaagacaaaacaaatctggctgtgtgtctaaagtcagccttgattttgatgtcagttaatttgcttgtgactttgaaaactttaaattgttgccatctttaacccttgagaaatgagtcatctgtttctgtaaagtagaaaaggacaaaatcagcaagaaagaaaattttattttcaaagttcaaagagaatgcaataagtagtggagatgatttaccagtaactgtgctattgtttttctcaagagtttgaaatactctcttaaggaacacaaaaagcaaacaattttaagaataattgtagaagtcaggttttctttctctcaaatttttgcaacaagagaaagccgaggaatttgcttggcataactataaaggaaagcatagagcagctattgcaattttttttaaagacatgattagaccaccttggtatcttcaatacagtttccaaattattttccttgtaataaataattcatgatcagtattattatcctaatttttcaggtgcataaactgaggcccataggtttttatatcgctcaacaaagtgactggtttccaaggtgaaggtctaggatctgagccctactctgtgactctgtgaactccatcctctgacctctactctagctcacttcttccagtgaatcttcatactttgattgcctgcattgtactttcttttcctatacaaataaagatggcttgcctgtcttactcaggtcatggagttgttataaatatcaaatatcacaatgtatgtaaacatggtttaggaatttaatagtgaagagtttttattttaatgcatatagaaagcatgattgattagtctgaaactggttgtttggatttagagcagctattttagtggtaatctgaaaactacctgccaaacacggtggctcatacctgtaatcctacaattttgggagatcaaggcaggaggattacttgagcccaggagttcaagaccagcctgtgcaacacagtgagaccctggtctttacaaaaaacaattagctgggcatggtgctgtgtgtctgtagtcccagctactcaggaagctgaggcaagaggatcacttgagcctaggaatttgaggctgcaatcagccatgatagcaccattgtactctagcctgggcaaggagcaagaccttgtctctaaaataaaaaataaaaagaaaattactaacctttgcttcctgcccctaccaccacttactaccctcccatagtcaagctggagaattccagagatttatagtaaatcttccccatattcccattcttccaggacacactcagctaccacacctacccatactttacctggaagaaggatgagtgtgaaagcaccattcatgcttctgattgcattttaacctaacactcatgatatacagagtttgaccagtcaaagatgcaaatcattcccaaatgtgctgggttcctgtgtttaatgagaattataggacttgctatccaccttgaggtctgctggagataaaccaaagaaaaatatgagcaacagctctttttcatgaataggttgaaaacttgcccaataattcttagcagttctaggacaagacccaattttctacttgcagccttgtttgaggtcccaggttgaaaaaattaaaagtcagatactgaagcaccccaccaccttgattcacaaatgcagtttctatgtgttacaaccagaatcaggatgcaagaaacttcaggacaagaaaacttgactttgtccaaagtgtgattttgtcagagattaatgcttctgttcccaataccaagtaagaaattgattggttcagatccacagaatgagaatgaggaggcactgatgctgctgagaactcagtgcattgcatgtcacacctaaagcacacatttatttttaaagatctcaactcaatcattctgtttgccaggcactgggctgtgagctttctatgaagtattttaattaatccttaacaaacactttttatgtgggggctatcattttacacatgaggaaacagctagtggatccaaagctagaacacaccccaacactgggctatttgcaaaaagttagcaaaaagtacgtatctggggacaactgcttccttctcccctatgcctttgtgatcagaaggagtatttctatgagaggtggtcctgtgagtgtatgatgaacacttaaaaacaaactataaagctccttttagtgtgttcagaagcgaaaatgttttctatgtgttactagactccaattcacagaattttgtttttttttttttttttttttttttgagacggagtcccgaactgtcacctgagctggagtgcagtggcgcaatctcggctcactacaacctccgcctcccaggttcaagtgattctcccgcctcagcctcctaagtagctgggattacaggcgcccactaccatgcttggctaattttttgtattttttgtatagacagggtttcactatgttggccaggctggtctcgaatgcctgacctcgtgatccactggccttggcctctcaaagtgctgggattacaggtatgagccactattcctggctcacagaaaatcttagaagggagatatatgagaaaagagaagggatcattgtctcctattacacattggaagctataacattctctagcatttttataacataactgaaagcaaagcttagaagtcagtggtgggagatgagttcgctgctacagtgtaggtacttcagccatcacagatttggatgggacttgtctggttctctgagtgccagcttccttggtcaaggctccatgaatggtctcccaggactccacacatacagaagaggtcaaccactgcagagggaagaccaggctttattccaaggtttatgagttgttgcaggcctcaagatgcttggagactaggaagggaagtggacatctgtgtcaatgccagaatgctagccagaccatgataaataccataagagggcactaggaaaatacaagcattcacagaaaggagtgtgcagagccatggtggagggaaatccaccacagagcagggagaggggcttcagctgtcactcagagttaaacctggaaaaatcagatgtctacgaagactgaactttatttagcgatgggagcagcaatagttggagaggaggaaaaaccattgcaggaaaaaggaacagctacaatcaaacacatcaagacggaatgtatgggacaagtgcagaggcccatttagctaagaagaatagtgaacgaataagaacagctaaacatttaaagagcagtgattctttttgcaagtaatttacatgtagcatcttatttggtctgctataaagtaggtgctatcagtataaggcaagaactatcactatagccactttacaaataggacctcggacttaccacctttctatgagaggaggtcctgtgagtgtatgatgaacacttaagtcaactggctaatctgcctagacagtaacagagcagatgcagcctgctcccaggtcccctttgttattatgacttccttttaagtacaatatgggagataaggttgtgaaggggagttgtggccagaagtcaagagtcctggaacattatcctaagataggatcgagaagcatagaaagccttgaaaatgttcaacaggagttagatatgatcagagctgagctttggaaagaccgaagctatccaggacattattttaaaaactgagttactagtttgcttgcttgcttaagcccccacttcaaggatgaagggaaaagtgctgatagttatttctgggtcagtgtcttctgagccagaatcctcaagtgcatttccccactccctctacactcattttagttgcctagaagagtcttacaaagttttctaattggctgaggatcctaaacccggaaacaataaatgaaagtctgagatttgggctcaatcaatgtcacaggaaagaaggcactggggcttatatttttacataaagatgctgcatttggggtagtcaaagctcacacattctgcagtcacccccattacaggaaatggtgggccttggatatggctgactgtaatattaactttatgaggaaacagactctgctctgaagacttatgacctgagggaaagatggacaaacagaagaccaaggcctcatggtgggctcctctgatagcctcctgtgctgctttcctcctcagaaatactgaggttggacgtgaggcactcttcagcaaaaggacatttctgcctttccagcactaaaatggccatgagtaaaattgatatgtcaccgtctcaccaaagtgaaaaactgaagcggactcctaaggccacgcatggagcaaaactgtttatgcaagaagcatttactgagcacctgctgtgtgctctgcttgattgacttggatgagaaccatgaacaatatgaacaagtgccctgccctcaagagtcttacattctagggcaggaggaaagacacctgtaacaatcaagagataataaaatgtctgtgaaagtaaaatcagatcaggtcataaagtaacagagcagtaggctactccacagagcttgccaaggaaggcctccctgaagaggtgatgtgtgagcagacactggagtgacgagaagaagccagcgtgcaaagggccaggcaagcacatctgatggagagagttcagcaagtataaaagcctcaaggcagggaatgtgtttcccatgttcaaggaaaataaggaacaggagcctggagcgtagacagggatggcatgtacaacagaaaatggaagtaaagggggccccactggccagatcatctagggccgtatttataaatttgggttttattgtaaatataagaagccccttgagggttataaacagtgatgcgactagtgatattaatagtattaaaataggactgtgcatgttgagtgcagaatgaatagcacagaagcaaatgtggagacagagagaacactcaattgggtactgcagaagtttaggtgaaaaagcctggtggttttgactaaaggtggcaatggggaggtagaggaatgagcagattcaagatacatttttggagacaaagacaacaagacttcctagttgactgaaagggaggtgggaatggagaaagagagagtgattaaagataattactaggtcttagtcttaagcttaaacaactgattggaaagtgtcatttgctgagtcagggaaaagtggggaggaaaaggagggtcgagaagaatccagaggtccaactgagttgccttatgtttgagatgcttactggtaaaaagacagatatgtgaattaggtagttggatacataagtcaggagtctaggacaggaaaggcacagtggctcattcctgtaagcccagcactttggaaggccaaggcaggaggtttgctcgaggccaggagttcaagaaaagcctgggcaatatagtgagaccctgtctctacaaaaaagatagaaaaaaaattagttgggtgcagtgacaggcatctgtagtcccagctatttgagagactgaggtaggaggataacttgagcccaggcatttgagattgcaataagctaggatggtgccactgcactccagcctgggcaacaaagcaagaccctgtctctaaaaaaatgaaaaagtaaaaaagaaaaaagaaaaagaaaagattctaggagacagttgagatcgctgagggttagagacataaatttgggaatcgtaaaaatttggatgcatttgaagccatagaaccagctgtgatcactcagggagagattaaacatagagaaacaaccagggcccaagagtaaacccagggagttcattcagcacctgtaggttcgtagaaggtgaacagtcagcaaggaccaagaaagtagaaggaaaaccaaaagggtacaagaacacagaagccaagaaaagaaagtgttgtttcaggaaggaggacatggtcaacaggatagagagagtgattaaagccaattactaggtgacatgttgcctaagataaaggcagttttgagctccttcaaaggtatctgtttcctttgttttgatattgtttccaaaaactacatatcaggtttgatacgataccagaatgcagttaaaatgtaatcagtttatttactcaagatgtgtgggattatagaaacattttatcaattaccatttccatttataacttgtgcatcagttatagatcctattgtaagattgatatgcagccaaactgtgctatatactttcagtgttcactgtgtaagatactaaagggcttattacactgtagcccagcctaaagacacatgctaattatcttccatcatggtgcctgcactggctgtacttctactgaattgtaagctctatcatggtgggcacgtgcctgatatgttcaatcaaacaatagtttaatgtttagtatgtttgtttgtttgttttgagacagagtctcactctgtggcccagattggagtgcagtggcacaatatcgactacctacaacctccacctcccgggttcaagcaattctcctgcttcagccttccaagtaactgggattacaggcatgcaccaccatgcccagctaatttttttgtgcattttaaatagagacggggtttcaccatgttggccaggctggtctcgaactcctgacctcaagtgatccttccgcctcggcccccaaagtgctgggattccaggtgtgagccaccaggcagattttttaaactttggctgataaagtgatttaatcattaatcagtcagtgttaagagattagccctcccattggacatgctgaaaacaggcagctggcgactaagtgaagtctcacaggcagaacatctccactaaatcacagtctagctccaaggaccccttgttattcataatatttactgcatatttagtccccacaagctcatgattaattactgcacagattcggatggacaacatgtgacctacagtttccctctgcacagtaattgtagagggaaatgtaataatacccagtcagtctaaaaagcctattagtccaattctccacaaaattccatgaaaatataacatcacagcctgttgacttccaagaaatagtttaccaagagttgccataaacattagtacattttagttttagtgatagggtacttggcaaatatacataaaatcatacacacatgaggcactttgataggcactgaaaaataaaagacatacttcctgatcttaaagagtcctaaaatctagttgggtagatgcttttcataacatgaaaagctaactaatagttagacattgaaatgagaaaaacgaaatgttatgaggttctatagaattgacagctattgatgtgggccaggtatgagatggatatgaatcttcagtggaatctctgataaacacagaaagtgggccgggcgcggtggctcacacctgtcatcccagcactttgggaagccgaggcaggcggatcacgaggtcagatcgagaccatcatggttaacacagtgaaaccctgtctctctctactaaaaatacaaaaaattagccgggcctggtggcgggtgcctgtagtctcagctactcgggaggctgaggcaggagaatggcgtgaacccgggaggcggagattgcagtgagctgagatggcgccactgcactccagcctgggcaacagagcgagactccatctcaaaaaaaaccaaaaaaacaaaacaacaacaacaacaaaaaacacagaaagtgaaggataaacagagtaacataaagtatgtgtgtgttttgttcttcctcaaaataaaaaattatcagtcctagactattttatgtgagaaacccaccttgacacctgtttctcattgtatggcaactacaaagaagtataatgctgaacagtgcatctctagagaacagcttccatgtgggacagtgtttccaaacagagaatacattttctatccctgtaattactcttctattataataagatgtcctttgacacacagaatggcgttgtagaggagcactagatcaagagtcaaagggtttcagaactcctgactctgctgtgaatttgatgtgtgtccttgccatggataggacagcagcgcacgggagtcaagagctctccagacatacctgtcattcactatttgtgtgattgtaggcaaggcatttcagctttctcagactttatttcatcatctataaattgggaagaacagtgtctccggaaactccaatgcatgttagtaagtgaaggaagccaatccaaaaaggctacctactgtatgattccaactacataacattctggataaaggcaaaaatatggagacaataaaatgattagtggttgtcaggggttagaggagagggatggatgaatcggcagagcacagaggatttttaaggcaatgaaactacctcgtatgattctataacggtggacacacgtcagtgtaaatttgcccaaactatagaatgtacaacaccaagagggaaccctaatgtaaaccatggaccttgggtgataatgatgcctctatgtaggttcattaattgaaaaaagtgtacctctctggtggagtatgttgctaatgggggagattatgtacatatacggatacggggtataggagaagtctttatagcttctcctgaattttatcgtgatcttaaaattgctctaaaaaataaaatacatttaaaacaatcataaaagaacagtacttcggccatagagtagtaataattaaatgcgataaatatgtaaaggacagcacagagcttcctaaatagtcaatgttcaataaatgccagctattactctgatcctgtttcttagcatacagcagatcaaaagctgctgactggaattaaaggtcagagctgctagaagttatactgatggtggccagatgttacaggaggatacagaagaatgctaggaaggaagcatcagaactcaggaaacatttcttccaaggctatacagggagggagcaaataatggtctctttgttttttgttttagacactgggtctggctctgtcactggggctggagtgcagtggcatgattatgactcactgcaacctccacctcctgggctctaacaatcctcccacctcagcctcccaagtagctgggactacaggtgcaaaccactatgctgagctaatttttaaaatttttctgtagagacagggtcttgctttgttgcccaggctagtctcaaattcctggcatcaaacaatcctcctgccccccaaagtgctggaattacagatgtgagccattcctggcctgctctctatcttaacagatcaggaagcatcagtaccgtgcagagtcacaacctatagcattgtgatgtaagaaaagcaggaacatttgcctaagaagggctgggttggaattcttgctctctgttggtcccgtgctaattctgggtccttgactaagtccattcacgtccctgaactggatccctgccatcaccatgcgcaataggcacagctcagctactgtccgctctacctcagcagacaggactaggacctttctggcccagcccatcttgttgtaaataacaaagcatgccccataggactccaaagaataaaaaatcatactccatttgtcacagctgtgataatcactcacttttgctctaaaaatggagacagtatgcacctcaccaggcaactgagagaattgaatgaagtcatggcttacaaagcatttgggacacacaacccccagctccgtcaatgttagtgtggctatgaatgttttctaaatgataattcacacgctcaggtgccagcatagagctatacttgctactattctgacctgggtattgtgcctccgttttgaaaattgagtattcatcccgttcctgagccttagtttttccaggtcttatgaactggcttcttcctaacccggcatctcacgctttttttttttttttttttgagacagagtctcgctctgtcaccaggctggagtgcagtgatgtgatctcggctcagtgcaacctccgccttgcgggttccagtgattctcctgcctcagcctcccgagtagctgggattacaggcacatgctaccataccgggttaatttttcggtttttgtttgtttgtttgtttgtttgttttagtagagacagggtttcaccatgttggccaggctggtctcaaactcctgacctcaggtgatccacccgcctcagcctcccaaacgtttttctttttttttttttcttaaagaaagaatggaaaaatgcatacataccgtgctctggtccacatttatttgctttcattttggtaatcctctgggtcctgctgtgtgcttgctagtcccttatccagagcctgaagcccagactcagaacacagtctgctggctgggttcttctcctcattagagatcgcccaaataccactctcattgcttggacatacaagtagaccatgtcccacctctcaatccttgaacttcgttcatgtggtaagataccctattacactatttcttctgaaaatttccattactaattgtttccccgcataaatgattgcagtatgatttggttgcgtgcctatctatggcactcaattcccactatcagcacctgcaaaaggctcagctcagtcaccacgtgctccatctgaataggcaggactagaacctttctggcctggcccatactattgcaaataactaaacaggccctgtagatacccaaagtacaataaatcatgctctgtctcgcagctgacatttcccctggaattcaacagtctagatatatcaagtagatgggtgggtcaggtctacaagaagtctatctacatacacatggtattgaaaagtctcctgtgcggaaaagtcactctcagagaaaaaggagtcaaactgggtcaagtacaaaacttatactatagagaagagacatgcttctatgagttcaaatctgttttccagtctaggcctcccacatattcccacctgaattctagtaagagagtaagagaaagaggctctatgtagtaaaacagtggaatgcactgtagggccacatgggaaacatttggaaaagtaaacagtaaggagagaggggtattccctctacttctgtaccgccttggcacacgaaggacatcagagaacctggcatctcttaggcattcaaagcacattggtggcattatcgtcaggaaagagacagcagcagctaaaggaagtgacagcaacaccctgttgggcagatggacagaacaggagtcgatgggagtcagaactaccctctgagagtagctcacctgtggatcctggaagcaaaggcgaggcattttcatgcaactttgcacccatcaacaacagagaaaggaagcttataccaggaaaagtagagaaataatgaatgtcatttattcagtgactggattattattgcactcagtgataataaacatcctgcctaattgatcagcagaaaaaaaaatgtattgagtgaagtagtctagggatcatgactccacaattattcattgagctcaagagccaataaaaacatgattacctagccactctgttgacgacagcagaaaaattatattcatgtattcatctattcatcatttaaaaataacctgtaagtacctaaccacacatcaggttggtatgacaaacaatgtggaaacagatgattaagttattctccaaaggcatctcataggtaatgatatgcaggttgagcatccctaatttgaaattcccaaatcggaaatgctccaaaatccaaaactttttgagtgctgacatgaggacacaagtagaaggttccactttatttcctgtttcacacataagtacttaacacaaactttgtttcataaggatgtaacacaaacttcatttccatttatttaaaatattgtataaaattattttctggctatgtgggtaaggtgtatacaaaacatcaacaaattttgtgtttggatttaggccccatcccccaagaaatctcattatgaacgtgcaaacattccaaaatccaaaaaaaaaccccgaattcaaaacacttttggtctgaagcattttggataacagataggcaacctgtacaatagaatttcaggttccatgacagaaatatatttgaagagctataaaagcttgaattaatctactgaggaaaacagcagttcatagaagtttgactgaggaagtaacctttgaattggacattcttaagcagaatgaaggcaaaagaaaatattatggaagtggacttttgcaggaggtaatattctaaagtatgtccacaacagaaaaatcaggtaaagtttattcttgtacattccttaaatcatccatgaaatatacatgaatttgtgtgtataaccttatagcatttttaacattaaactttgagaaccactagtcaggtctaaggacatcacaagaaactgtccacatggtctacgtataaagatcattctgcttttaagataacttcttaacaagaaataaacagaaatttctattgtttctatttgtctgaagggtttactctattttattttaatatgaaatctctatgaccacctaacaacagaggttcaaaattcatgaagcaaaaactgatagaactgaaaagagaaatagaaaaatccaaagtgatgactggagatttcaatttcaaccacaatttctctgcagttaatagaacaaataaaaaataggtaaggatatagaagacatgaacaacagtaccaatcaagtggatctaatgtctatagaatattctactcaacaagaacagaatatacatttttttcaagtgcttttagaactttcaccaaattagaccgtattctgagctataaaacaaactttaacaaatcatgaaaactaaaaatcatactaattatgtttcctgcctgaaagatcaaaatagagctcaattacagaacaatagctggaaggtcctcaaatgttgtgaaatttaaaaacatgtttctaaataaccataagccaaagaagaagtaatgaaaaaattagaaaatattttgaattaaataaacacaaaaccacaacatattaagtattgtggtatgcattcaagacacagcttaaatgaaaattaataccaccaaatgcctaaatttttaaaagagcatctaagtttccatcttaataaactagagaaagaaaaacaaattaaacccaaaacaaacagaaggaaagaaataacgaagttaactgaagatatcagtaaaattgaaagcaagaaaacaaacaaaaccaacgggaaaatcaaaatctggttctgagaaacaaatgaataaaactgacaaatttctagccagattgaccaagataaacagagagaagttacaaattatcaatatcagggaaaaaatgggaaacatcacaaagacagcatcaatatttaaggaataataaaggaatgtcacaaactagatacttaaccacactctgactcactcaaaaacattttatgctcactcaaaaacctgcttatgaaagtttatagaggatttattcataatttcccaaatctgaaaacaatccaaatatccttcacctggcaaacagataaacaaatactggtacattcataaagtaacatagtttcacattttgattaagtccaatttatcaactgatgcaaaagaccacaagaaacaacatctaagattgttttttttctagcatttttacctgattgctatggctcttcttcaaacttcttttccctcaaattacatttcctaaccatatatatatatattttttttttttttttttgagacggagttttgctcttgttgccaggctggactgcaatggtgtgatctcggctcaccacaacctccgcctcccaggttcaaacaattctcctgcctcagcctcccaagtagctgggattacaggcatgcaccactacacccggctaattttttttttatttttagtagagacggggtttctccatgttggtcaggctggtctcgaactcccaaactcaggtgatccacctacctcggcctcccaaagtgctgagattacaggcgtgagccaccgcgcccggccatctaacataattcttatccagtactagcatatggctatgacaatggattcaatgttggataagacagaaatgtaagcagatgatgggtcttgaggtcttttgcgtcaactgttcatttgccaagtaacatgattcactcatattattctcatagaaacttaagctcccttaataacaaatcctacatacttctccagaatgccaaacgagaatagattttctagtttagaaatgagaaaattgtgacaatttttgaagtactgaaaaggttataatcagaggaaaggacccagtataaacctctgtgatttttttttaaagaaggcaaaaaaggaaaggcagatgttgtgaaggagtgaaaagagaaaaagggagagtgtagtgttacataaaatctcaatttaggctgaacatccaccaagattctactggaaatcaagcattttactctcatttcatttccctaggaatcctgtgaagtaggtaatagctctccatttatagatgaggaaaattcagtttagagtgataaatgacttattcaatgctacattgctagttaagtgaaggaggtaagatttacactaagaattagagattatacactttttttcaagtgccacttttgggagaaaaaatgattaaatatcagtataaaagtattattttgaggaaagaaggctccttaaaaaggtactccagttgtttggaataattgcagtctcgtttcagtctcagctctatatgcagtacagctcaataaagctctaatatgcagtacagctcaataaaggtggaatgccaaagttctcatcttttagcctcatggctgttgtcccacttaagggacacagaatggctttataaagaaattaacattaaccaagtatatactgccacttatctctcttgcctcatttctcaataaagaaacctgaaagttactttctatggctagcttcaccttgaagcatgtttgttttatctaataaaggaactgtttagcttaattccattactgattttggtgtcagatcacacgatataagctaacaaagatctacttcactgattgcattgcaacattatctgaaaataaaagtggggtaggaagggaaggagaagggagagatgaagagaggatggtaaatgggtacaaacataaaactaaatagaaggaataagttgtagtgtcagcagagtagggtaatgatagttaaaaataatttactgtatatttcaaaatatctagaagatatttaatgttcccaacacaaagaaatgataaatgttttgggagatggatatccaaattaccataacttgatcattacacattgtatgcatgccatcaaaataccacaggtaccccataaatatatacaattattatgtgtcaataatgaaaaaaagttagagttttatataacttctattatagtccttttcttttatcctcacacacacacacacacacacacacacaaaaagagacagaccttaaacaattatacagaaagttgtctacaaggatgttaagagtaataaccaatctactttttaaatagttgagtgggttttcagaaaaaaaagtattcaataaacaggaaatatgtgcaagaataaaaagagaaccttaattataattatgtatttcttttcagcagagtgttaaactctggtaatagaaaaaatatatttttttcttttaatccatggacattttatttacaaaatcttatgatcataggtttattaatgatcctcagacgttttactacaaaaaatgcttgagattataaaccacgacagaaacaaataaaaccacctcatgatagtcttggaacactaagaaaaagtcctaagactaatattaattgacttctatggtcaatggttctctgacattattgtgtgaccttaggtagtaaattagccactccacaaatttgtttacttatttaggaagagaagtagtaagaattcctttcctattaccacctcaaataattattgccaaattatatgaggaaatacacaccaaaatactttgaaggcttcgaaattcagcagaacttcaaactatcaaccaaacaatatacgagtgctccagttcctctacattctcaccaacatttggtgttgtcacttttgaatttttttttgagacagggtctcactctgttgctcaggctggtgttcagtggtgcagtcatagctcactgtggtctcaaattcctgggctcaagcgatcctcccacctcagcctcccaagtaactgggactccagacacatgccaccacacctagctaattttatttatttgtttatttttttgtacagacaagagtctcgctacattgcccaggctgaactatttttattttactgttctgataggtaggtatgtagtgatatatcattgtgattttaattgttatttccctaggtgttggacatctttttatgtgcttatttgctatctgtataactttggtaaaatgtttatttatatctttgcccttggtctaattgtttgcattcttactgttgtgttagaagttctatagtctatattctagatactagtcctttgttagatatggggtttaccattattttcttccggtctctagcttggcttttcatccttacttaacaaagtctttcacagggcaaaaggttttaattttgataaagtccaatttattcactttttcttttataaatcatgctttcggtatcaagtcttagagctatttgcctaggactagattctgaatattttttgctttttctttacactttttataaagttttacattttacatttaagtccatgctccattttgagttaatatatttaaagtttgtacaaggtgtgagacttgaggttcatttattttagtctatggacatttaatcgctctagtatcatttgttgaaaggtgatgtttccttcattgaattgcttttgaatctttgtccaaaaaatcaattggtcaggctgggcgcggtggctcacgtctgtaatcccagcactttgggaggccaaggcgggcggatcacaaggtcaggagatcgagcccacggtgaaaccccgtctctactaaaaatacaaaaatttagccgggcgcggtggtgggcacctgtagtcccagctactcgggaggctgaggcaggagaatggcgtgaacctgggaggcggagcttgcagtgagccgagatggcgccactgcactccagcctgggcgacagagcagactccgtctcaaaaaaaaaaatcaactggtcctatctgtatgggtatacttccacaccatctattgtgttccaaactatctattctgattgctagtggatttatgtgtctgttccactgataatcttgatactatagtgacatagtaagtcttgaaatgaggcagatttatttttatcacattatttttcttttcaaaattgttttagctattttagttcctttgaattttcatatgaattttaaaataatctcaatatttataaaaattttgctcatattttgataagaattatgttaaatctgtatgtcagtttgtgaagaactgagactttactatgtcgagttttccaatcagtaaaaattgcatttatgtccattaatttacattttgtgtgcttcctttgattagtactgtagttttcagcacacaagctctgtacattttgtaagatttacacctaaatatttactttaaaatgtttctgattattgtaaatggtgttataatttaaattttgattttcatgtgttcattgctatgataaatacaacagatttttgtatgtttatcttctatcttatgaatttgctgaacttatttatcagttctgtggatgtttttgtagatttttttcattttctatatagacaattattccatctgaaaatggtgactgttttttttccttcctggtttgtatgccttcccccagccccatcttattgcattagcaataccttccagcactatgttgaataaaagtggtggaacctgtttctaattgaagggaaaaagctttcaggttctagccattaagtgtaatgttagctgtagttttcttgcagaggggatagatgttctttatcacgttgtgaaaattctccgctattgccattttttttttttgcgacggagtcttgctctgtcgccaggctggagtgcagtggtgcgatcttggctcactgcaacctccgcctcctgggtttatgccattctcctgcctcagcctcccaagtagctgggactacaggtgcacgccaccacattcagctaatttttgtatttttggtagagatgggatttcaccatgttggccaggatggtctcgatctcttgaccttgtgatccaccctccttagcctcccaaagggagggattacaggagtgagccaccgtgcccggcctccactattgttatttttatgagaatttttttatcataaatgagtatttaatttttttaaatgctttttctgaattagttgatatgatcatgtgagcctttttttctttagcctgttaatacaattaaacacattgactgattttcaaacaatgaatcatccttgcatttctagaagaaatcccactttgattatgatgtataactctttatatgttgctgaattctatgtgctaatattttgttaaagacatttttatttatatttaggagatacatcgctctttagtttccttttttgaactgcctttggttttggttcaaggtaatactacttcataaaatgatttgagaggtatcttctactcttttgtctggaagagattgtgaattggtgttaatttttctttaagcttttggttgaattctctggtgaaatcatctggacctagatatttctttttggggagttttagattataaatttaagttccttaatagtcatagggccattcaaattctcgatttcatgttggtttacttgtaatttgtttggaattggcctgcttcatctaagttgtcaaattcatgtgtatagagttgttcatatgcgggcaggggtgcctcactaccatctaacagagatgtaaattcaggctccttcctgggctgcctctgttatcacccaggtgagggtgtttggtctcaacagagcctcacaaaggtcaaagtctacgttttctactcaggctttgctaacatgagcagaggcggggccaaacttctttctgtggtgtttggctggaatagaaaggttattatctaaaagctccatatcttgccagcctggccctttcctgatcatttggctagagaaaacaggtgtgtgtgtgtgtgtgtgtgtgtgtgtgtgtgtgtgtgtgtgtgtgttttgctttgattttgatttggcttggttttattttctgtctgcacgtgtgtgtgtgtgtgtgtgtgtgtgtgtgtgtgtttggtttgctttgattttgatttggcttggttttattttctgtctgcacctgtccgcatttccaggattctagttctttagcattaagaactcactgccatgtggtttttcaggtcccaaaggccccagctcaaatgtttcttttctccacttttcagagtcctttatgtatattttatgtataatgttcagaatttttacttagtgggatgaaaaggcaaagaatgcctacttcagcttctagaaacagaagtcatccaggatttagttttaaatgaattggtcaagatgaatttctggtacataaaataggcctagtcaaaacatgaataatttatccatgaaacaaattccttttcgtgacatttttccttggtgggccaatctgctattccccatcagaaaagagcccaggtgagagaagaagaaaatagaagaaaacagaaaatcaggaggactttctctttctcactcctcacttcattcctgcctcactcccaaggcaagttcagagccccacagtaccaagagttcaggaaaatccaagggctgaattcaacatccatctagccagtagagatattttaaaaatcacacatattatactgacttgaaaaaatattttcagcacctactttttaagtactcttatgctaaacacaatggagaaaattaaggtacaaaggcatagcctctttcagaaaatccataaaacctgtatccaaagaactataataatgggcaggttctgaagaatgacatagaatgggccacacatctctaggataggatttaaaatgtcatttaaatataacacaaatgtttgtattgggaactctaaattgtccttgtctacagccttcttccttccctttcttacaacctataagatcagacttaagtaaactcctaagctaattttgaatcatttgtcctccctaagcccataatcacatggctaagccaagaattattcaaacctaattctcccgcaagacctcatccattgctcactgctcctgaagatggtcttgagtatccccctggatctgggcctcagactgtctttgccactctcctgtgttaccacatggagttggtccccgccatgtttggtcaggtctcttagaatgataacttctaacatcatggatcctgaaaattagctaatgtgatttccaactactgtgtctcatctagctgatattatcaatcaattcatcctgcctgaatttataacaccacatttggatatagtgtttagttgcttaacatatgttcaataagcataaattaaatacatatagacaaatggtctagagcagtcttcatcatgcttctccggaaggatctagagtacttatacaatttgagaagattgagtttcataccaagtagggacagggtctggaaacaggcagtacacaaacacttgaatgtatgttaagactgagacttctgctacagaaagtcagaggaaagaatgtgactttcaggtgagatcagcaaagaaggattccctctgccacaaaataacaccttctttcccagaaactcagatttcctttgatataattcactattaattttcactctaggagatgaagcatctgaatgaatgttcctggaatatgcttggaacatgggaataaatcatgctagttgatatggaagacaaacacaacactccagcaatactctcttaggaattccctcatcaccatttaaattgttgattttctgctcttctgtagaaatctctagttctggatgaacataagcactgtctatattcgttagacagcacaatacatattagtctttaatttatttcacctacaccaaacctaaattttttcttcttctaactttatgtcctaattttctttacttaattttgtctacatttttgtcatcattttctcttagatttttgttcagctttccttgaaacccaataaaagcaaaaattatattgagaaaagacaaaatttcacatcccatattctacagcttgctacctctgggcaccaatggacattcaactgaaatataattttttaaagaattttatcagtataatagactcttggacttgaattatgaagcctaacaactggtgctaaatcagatgaaattgtgaagaaatgtctgcagtgtagctctaactaaaagctatattctaacaagtcggcgatggagcctccaactttctcatgcctctggatggaatttattccctaaactcagtaaagccactgactttcagaaaatgaataatctaaaaaaactgcaaaggcaaggcttttgttctttaaaaaaagaaatgaagctaacttctgcttatggcaatggagatcagtttattttgcaccaatttcctactgaaaataactataaaggctgaacaaaatgtccaaaacccatctgtttgaagtcatcagagagccatcaaggtaaagaggggcttcagggcaaataatctgacagaggcaagccaagagatgttcaccccccaaagcagttactaaaggcttggaggttgacaggagtatttaaaagtcgcactgagaaggacaacacaaatttgagtttagtgccttccaggaatgaaaaatccttggataaagacttaggatatcactctgcaatctacagggcttcaccctgcaagtgagtgtaaacagaaaatagaacaagccttataaaggtttaagaaaagttttaggtcagctcaagtcctaaaggattaaggtgattggcatctcacttagctgcctggtagaagcaagttgaagtcccacctggagaaaaacattcactgaagcctcaaaatgccttgcaagttttcatctaaaatgtatgacactcaatgaaaaattaatagcatattaaatagatttgaccagcggggcgtggtagctcacgcctgtaatgccagcactttggaaagctcaggtgggcggatcacctgaggtcaggagttcgagaccagcctggccaatgtggtgaaaccccgtctctactaaaaatacaaaaattagctgggcatggtggcgggcacctgtaatcccagctactcaggaagctgaggcagaagaatcactcgaacccgggaggcagagggtgcagtgagccgagatcgcgccattgcactccagcctgggtgaaaagagcaagactccatctaaaataaataaataaataaataaataaagatttgaccagctaacaagagggaaagaaaaccagacagtgcaaaattatccatgagaaatgcagttgttgtatttatctgataggacttaagataacagtgattaaaatgtttaaaagattaaataaggcaatacaattcagtgaagaacaaaaaattataaaaacaaagaaaatataaattctagaactgaaattaagaactttacagatagatgtaacaataagacatacaggactattgaaaaaatagtgaattggaagataggtcagaaataaatattgagaacaaaagagggagaaaaaattacagaaaataaagaaaagagcatgcaaaatttatgggacaggtacaatgaaaagatctaatacacatgtaactgaaatttcagtaagacaatgaaaagaaaaatggggcacaagcaatatttgaaaagatagttgctgaggatttttccaaactgatcaaatactttattcaagaaatgctatgagccttaagaagaaagaatacaaagaaaaccacatagctagatgcatcatagttaaatttctgaaaaccaaagtcaaagagaaatcttaaaaaaagaaagagatagagaaaaaagtgtattaacttcaaaggggggacaataagaatgacagctaatagctgacttcttaattgaaacaatggaagccagaagacagtagaaagatatctttagaaaggggtgggggcagaggtcaacctgtaattatgtatcagtattaagtgcaatacaaaaattcacaaaataaaagcattttcacacaaataagaactgaatgcaccagcagcagatgaacagagaaaatactaaaggatattcaagaagaagtaaatttgtactaaaaaatgtgtaaaaaaaaaccccatctgtttgaagtcatcagagagcatggagaaaaacattcatttaagcctcaaaatagcatattaaaaatatttgaccagctaacaagagggaaagaaaaaccagacagtgcacacaaatatccatgagaaatgcagttattgtatttatctgataggaactttaagataacagtgattaaaatatttaaaagattaaataaggtgatacaatttattgaagaacaaaaatttggcgatgcagaaaggaatgaagagtaactaaaaggagtaaatatgtggataaacacaagtgaatattgactataaaacaataatactaaagtcttatggattcttaagtatttagaaaattgtaacacatgagaacataaattagagtatgggtaaatgaggctaaagtgtattctaacttttgcattgagttggtgttggtaaaaatagtaatttatgttagacttgaatttcagggatgtattatatttcataagctagggtaagcactaatacaatggtaaaagaatgtgtatctgaccagctagtactggggagaaagggaaaaataaataatactgaatccatccaaaagaatgtaaaaaaaaaaaaaaaagaacaaataaggaatatgctgggttaattagaaaataaatgtaaagttctagattttaaacttaatatatcaataacattaaatgtaaatggactaaacactccaattaaataacaaacattttcaggctggatttaaaaaataattatatgacacaagagactcaccttaaatataagaatataaaaaagttgaaactaaaaatagaaaatatatataccataaaaatactaatcaaagtatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatcaaagtatcttaatctcaaagtagatggtatagcaagaagcaccactagagataaagatcactttccataatgatagaacagtcaatccatgaggaagacacattttaaaacttgtgcacagttaataaatagtgtcagaatatacaaaggtaaattattagaagtaaaaggagatatataaaaattcaaaattgtagtgagagatttccatacatatacttattaactgatggaccaggcagaaaaaaacaatcagtaaagagataaaagaccaaaaaaaaaaaaaaagattgcaaacttgatctagttgaaatattcaaaacattactactgtataataatattcttcccaaatgcataatttaccaaaattaaacattatctatctatctatctatctatctgtctacctacctacctacctacctagtttcaaaggtttggaaatgtgaagtatattttccaacctaaatggagttaacctagaaatgggtaagaaaaataagtagaaaatatcatggacttggaacatagactatttttcaataattcatgagcaagagaagaaattacaagagaaatttaaaaatagtttgaaataataatgataatgtaacatctcaatacttgtaaggttcaggtaaagtcatgcttagaaagaaatttatatttaatatatacatgagacaaaggctgaaaaatcaacgattaagcactaaactcaaaaaatcaacaaagagcaaattaaatgcaaataaagtgaaaactagaaaacaataaaaaataagagtggaaatcaatataactgaagcaaacacataatagaagaataactaagaaaaaaggtggttctttgaaaaggctaatatagttgatgataacttgtcaataccctgatcataaaaaaggcagaaaaaaatccataatgaacaatgagattattacagctcacataggcattaaaaaggtaatagaatattttgaatagctgtatgccaatgcatttgaaaattgacataaaatgaacaaatttctgaaaaaacacaagctaactaaactgacacaagaaaacgtatcatttctaaaaatatgaatatttctatatttgtgaaagaaaatacatttataattttaaaacttttcataggaaaatctataacctcagtgttgttactggtaaattttaccaaacacatttggaaaaacaaaataccaatcttacgttaagttctttcaggaaacagaaaaaacgtggaacattttccagctgtttttttgaggttaccataatcttcatatcaaacctgacaaggactttacaagaaaaatcaaacaccaatcattgtcataaacccgtatgcaaaaatattacaaatttgtgctaaccaaatccattaatatagaaaaaagataatatacaaccaaacagcctagttcggtttattccaagaatggaaaattggcataacatgtaaaatcagttaatgtaattcaccatatgaagagaataaaaggaaacaatcatctcaagaaatgtaaaaaaaagaagtcatctgattatttatctgatttatttataataaaagcccttagcaaacaaagaataaaaaaaaaagactttattggccggtctcacgcctgtaatcccagcacttcgggaggccgaggcgggcggatcatgaagtcaagagatcaagaccatcccagccaacatggtgaaacctcatctgtactaaaaaaaatacaaaaattagctgggtgtggtggcatgcctatagtctcagctgcttgggaggctgaggttgcactgagctgagattgcgccactgcactccagcctggtgacagagtgagactgtctcaaaaaaaaaaggactttatttatttagtaaacagtatctagaaataacttccagcaaacattatacagaatggtaaaatattaaaaatttttcctctaaaatcaagaacaaagtaaaaaatgccagtgttacttacatttgacatgtacaagaggtcctagtcaatgcaataaggcaagaaaaagccaaaacatgtgaggattttaatggaatgaatgacagaagtctagtcctcttccctttcaaaataagctgtggcttccagaaaaaaaaaaaaaagagaaaggatgatgggaatgaaaacaacagcagatatctactatgtttctctagatgaaaataaatatagttactctgtttttagctgacaactagtcagtgtcaggatattgatgaacctcagtccgtcaatcagaaaaactactgctatcatcacacagaaggggttagaattcaagctgtactgcctgctagctgtaggacctttgacaggtcatatagcatgtctagcatttagatccttcatctgcaaaatgtgggtggcagaagtacttgcttcctctgcctgtatgaagattaaataaaattatacaatgtaataaccctaacatataaatacaaaataaacgttagatgaattttactgaaattattagtaacaactccaaagccttggttccttcagttaaggcgaccactgaagttaatctcatgtgaaaataaattataccccaaatttaacacaaacaactataacaggtgatctggaactgaaaataataacaaaaaattaatgaagcttacattaatgagatatttaaatattaccttacttttttcaaaaagtgttccttttctctctctttcccatgatttttttaaaaaaagcttttaattgctgcaaaccggcagaaaaatacttatttatatcttaaaggtactgctcaatgaattttcacaaactaaacacgtccatgtaaccaacacccagatcaaattcttcccatgatttgatcattcagaaaatctttgacaaagaggttgacaaactcaagctggagtcagacaacccagatgctaattctggctctaatagggatgcactggttgacttaaattagctccttccctacatcctttgcatcctaatttttctcatgtggaaactaagagcaacacattcccctgcccctccaacctcttgtttcacagtggagttccaggaccataactgcaggcaaccaaaaccgtcttcctaaagctccctctcctttagcttccatgagtctagaccttcctgaatttcatccactgcccccggattattgcttagtttagtttctgttcatctttgaatgaagacatttcccaagattctgttctgcccccaactctcctcagtttctcattaaatttctcactgcactttctcattcaattcctggttagtttcatctgatcacctccatgtccagacttccaagtgcaaaatccaaccctaatttttctccccaactccagtccaagattttcaactacctgctgatatcttcaagtcctgttgatacatcagtcccaatctatcaaaagagaaatcatctttcctccccataccttctccctatgttatattctttactttgattaccacttctggtcacctctgtaagacacctgggaatcatcagctttctctggttcacttgccaaatcttgttaattctaccaccccaatatcctttgaaatgtccctttgtcactatgcctaccccacttctctaattcagttcatctgcctgagggatttcaagagtttcctgactgatctgctactcatggatctaatttctgcaatgcatctttcattctctaatggacttcttttcctaaaggtgtgtcagatcatgaaaatttcctgcctttagtcatcctacataaaagcagaataaagaacaaactccttggcctgtcaacctaaaaggacggttcctttccagaaccatccaccatgaaatagcatcatacaaattacactggagcctcaccagagtgtgcactgttcctgcatttccataaacccatgattttctaactttttgcctcttctgtactcaccaaagtgatatgtatccttaaatttcttccctggccttcacaatcagaataaattagcccttcatttcagaaccaacaccacttttttttaatacatatataagaacttaaaaataaaactacttttgtctactttgtgtcaagcatttgaataggtactttatatgctataattcatttaatcctcattagttgaatcttcacagcaactttacattttagagatgagaaacttggtctaattaaggctgaatggttcacccgaggtcttactaaagtgaagtaaacgtaggagccaggatcagaatccaagactttgggattccaaagtcaattttctttatacttcgcaaaataatttctacagctaattgtttatatgtgtctccctaaaagactgcaagctctcagctgagaatgtgaataatctatttcagcccactacctcaaccctgcaaacacacagacacacacagacacacacacacacacacacacacacacacacacacagagacaccctaattgggttacttccacaacagtttgactctgtaactgttgaggaggtgaatgaataaattatcaaggttcttacattaatacctactcagatcttatgatagatattaatgacaaaagaggtatttctgtacctgtctctgtggaacttgcaaacacagaaaagaacaataacaaaataacatcagttgtagcatttactagtccagaaatagctcacctatgaaacaaacacaattttaattcattttccccatcccctaataggaaaatagttctttctgtgggggccaagggaaaacttccctgtcacactctgaaggttcactgaaaatcactgacaaaaggcagattaacaagagaaaaggcatacaaattcatttggtcatagttttgcatgacacgggagccttcagaatgaagagccaaagagacaggagaaattgtccatttttatgcttagattcaacaaaggatgaacagctgtgttgaaacacgattgggcaaaaagggaatgatctaatggtaacagactgagtggggaagctcagcaacgcctgtctgtttagatttctgggcctctctgaagctttccttccttctgggtatgaggcaggcccctctctggaatgcaggtgttatgacctacagtcaaacaagtcagataagttctttacggctagtttttatacagaagtggggaggagtgtagggggcagttagagtagtatttttaggttttatggctggctttaggggaaaggggttctggcttctatgacccgccttcaggaaggggaattctagtttctatgcctaaccttgggggagagtaagaggccagagacaggagggaacgaggtcagagaaacatgcttctgagtccctcatattgggatatcattttctgagctttaacatttctgtaagaataatgacaactaatttgaggtgcagcactaaaaatagaaggaatctagcagctcttgaggggtccatcctgagttgctttgttctgatcacttagcatgtgatcttgctacctagaaaattattttacctgtggtttttctcattgaaacccaggccataaattccatcctgcactaccttccttccactcgatcacatttgcattttttggctgccacgagacttaccttgagttctgcttctttttttatttttatttttgagatggagtctcgctctgtcaccaggctggagtgcagcagcgtgatctcggctcactgcaacttccacctcccaggttcaagcgattctcctgtctcagcctcccaagtagctgggactacaggtgcccaccaccatgcctggctaatttttgtatttttagtagagacgggtttcactgtgttggtcaggatggtctcgatctcctgaccttgtgatctgcccacctcgggctcccaaagtgctgggattacaggtgtgagccaccgtgcccggcctgagttctgcttctttccaagatagatcctctggttttctgttgattctgtgagcaccaggtactccaaagaatatcatttcaacaaacagttttctgtttaaaccaatcaaagtaagatcctatggcttgaaattaagaatcttgcctgacataatccctgtctcttgataaacacaaacaggcaatcaccaaaccagtgccataactccacaactcaatttttaaaaattaaaatataataaatcccctctcttttcatttattcgttcgttcatggcaggtacatttctagataatgaagatacagttataaattttgatggattttacaattttcatatctttgttattggcaaccaaagggtataacatgcacagtccagacaaggaagttaatcagaaacagtaaaaacttatcttcccgaaatgataacctgaaggtcaaatacaacaggagctactcttgccctttcaaatggccaacaatctgaagatatcaactaaatgccaaatattaccaaaagtaaatactataggagttgcccagtttgttaggtgagagtttaaaggaaactttagaaagaatgagcctgaaatgatgggaggaacacaggtgtgtatagagaaggagggatggaaccatttatggtgaaattttctcagaaatggcacaaagaaaggagctcaagaatcacagtcaacacccaaggaggagggtaattcattggattgaaaggatcccagaggaataaaaagttgtagaagaaaagaccaaactattgcatttgctcaccaagttctagagaattattttatcctctaggtcacagagatgggctgcagggggtggatagataagatgtggtgtgcaagttcttaaaatatgtactgcatatcatacattttaggtgggtattggacaattttcttagtgaataaagaggaaattcatttagcaaaaatcaaaattaaggtaactctagcattctttttcctttctctctgaaaaggtaataattgtgatatctgccaatttataatagaaatgtttaaaaacaaaagaattaaacttagagagttctccttaaaagtcagacaaatttatcaacaaaagagaagaaaccattgtctcaagtgtctttttgttgtttctttattcttcttattttctgcaaaaaaaaaaaagaatgagcctatgaaaagcaatgttaatgatggcacactctggggttttcactaatgttttaaataggctttacatagagcagcaattatgtgagatgatatagttaaacagtatcgataataaaatattccatttgagcacctcaaaatactttggactaattcatattagaacatcttgctatcagaactgttgagtttaaaataatatacacatatgtatatgtatactcatatattatataaacacagttacacaaaagtaaatttatttattaatagattcatccctttttatctatggtcataaaattcaaggatcagtaatagaatccatagatcccctaaattcatttgtgatttttttttttttttttttgagatggagtctcactctgtcaacaggctagagtgcagtggcaccatcctggctcactgcaacctctgcctcctgggttcaagcgattctcctgcctcagcctccagagtagctggaattacaccactatgcacaccacgcccagctaattttttttttttttttcagtagagacggggtttcaccatgttggccaggatggtctcgatctcttgacctcatgatccacccgcctcggcctcccaaagtgctgggattacaggcatgagccactgtaaccgactgcatttgtcatcattttttaacatctttcttattcataaaccaattagctagtgggaaaaaattaattagcatttgtaggatatactttttttttttttgagacagagtcttgttctgttgtctaggctggagtgcactgacacgaccttggctcacttcagcctccaccccccaggttcaagtgattctcctacctcagcctcctgaactacaggcatgcaaccaccacacccagctaatttttgtatttttgtatttttagtagagacagagtttcaccatcttgcccagtccagtctcgaactctagacctcaggtgatccacccacctcagcctcccaaagtgttgggattacaggcgtgagccactgcacctggccaggatatactatcttgattttttcctaatcttaactttaaagatgctcctatgaataatactaataaggtcccaggtaatgagagagaacaaagggtaaagagtcttggtaattcccaggctagacaaatattaatagacctatggagaggtacaagacagctgacttgttagaactgtgcagtttgttactgaagccaaaaatttggcagtaatttctagacagtaatttcgtaagtgttttttttttttacatttatgcccccatgtttaacccactagcaaattcagttgactcagcccccaaaacacacctgagataatctatttctaggcatccccattataatcaccctggtcccatggaccattatttctggcctgaactaatgcaacagcttcttaattggttttgctgttgccattcttacccagttacgatccatttgccccatgacttaaagaatgaactttttttttttttttttgagacagagtttcgctctgtcaccaggctggggtgcagtggcgctcggctcactgcagcctccccttcctgggttcaagctattctcctccctccgtctcctgagtagctgggattacaggtgcccaccaccacacctggttaatttttgtatttttagtaaagatggggtttcaccatgttggccaggatggtatcaatctcttgacctcgtgatctgcccacctcagcctcccaaagaatgaacttttaaatacttaaccagatggcttcattcttcttttaaaagtttctcattgggttcacattgctatcagtaaattaggaacttcttactttggcatacaacgtgagaagatggaactgccatctatgtgcccaatcttattctttgtcacggtctttttcatgtaccatactcccagctgcccttcctcagttcctcaaacacaccaatcccatttcctccttacggcattgggactagctctcacatgatttgaaactctcttcctgctcacctctccatgttaaccctaacttaaatgtcacccccttaggccatgggaacacccaatttaacctaattcttcagccacattacatggctcacctttaattctctccatagcacttagtgctgtctcaatttaccttctttctttctccctccctccctctctctctccttttcttccttctttctctctctggttttttttttttttttttttttttttgagatggagtctcgctctgttgcccaggctggagtgcagtggtgcgatctgggctccctgcaagctccgcctcccgggttcacgccattctcctgcctcagcctcccgagtagctgggactacaggtgcccaccaccacgcccggctaatttttgtatttttagtagagacggggtttcaccgtgttagccaggttggtctcaatctcccgacctcgtgatctgcccgcctcggcctcccaaagtctctttgtttctttctttctctctctctctttctttcccctttcccttctaaagatcaagaattatgcatgctttgttcatcactgtgccaggtatggagtatgcactttaaaatgcatatatatatatgcgtaaatatacagctatgtacatatagtttacattttgatatcatgcagaccgatagctatgaaatctgattattcattcagtgaaggtttactaaacacctatatattccaggcactggaatatgagacagacaagactactgtcttcatgcagcccacatttagctcagggagacagagaactaacaaacaaatgaacaaacaaaagaaaatttcaggctgtaataactgctaggaataaaattaaaaaggtaatatcaaagaaagttataatggacttgttcaaaaagcttcattaaccaaacgcaccaaaagaatcaattgaaatgttcaagtagaagacattttgcaatttttaaatatcttattctccaaaatcttccacacgtttggaagcagttgtccataaactaccttcgaatgaaacatccactaaattactgccactagaaaaagaaaagactggctcaatgctcaagattaaaatgcaggctgacactttctgctttacttgttttggggttgtgtggagaaatgctgacatctttgccttttttctttgagatggaatctccctctgtcacccaggctggagtgcaatggtacgatctccgctcactgcaacctctgctgcccaggttcaagcgattctccttcctcagcctcctgaatagctgggaatacaggcgcccgccactgtgcctggctaatttttgtagttttagtagagatgggagtttcaccatcctggccaggtggtcttgaactcctgaccttgtgatccacctgcctcatcctcccaaagtgctgggattacaggcgtgagccaccgcgcctggaccatctttgccttttttgaaaatagaaagagtagtaattcttgcattgagaatatgacataatcccaaccccaaaccatgagtctcatggccatgtctaagccacgccctgacgatagggttgggatgactacgccaggcttagtaatgcacagggacaggaggcatttcggaaccacaccacgacactgctggcaagaaagatgggaaaacggcagcaattctgtctgctgtgctttgtgtgtgtgttctacctggctgattgaatttcctcccaacacctacctcagatgtgttgtctaggtgaaaataagcacttcaatgagctggtctaattttaatcctcagcccttcccagtcagccccgcccccatgtagttacctccgtcatgacaaagaggaacatcccaggtgcaaatctagcacagtttccctatttcacctgtgtccccctccccatcttcatgccagcatcagaaacaagagtccaaacatcctcggcaacactacagaagctgttcaaacaatccctgtgttctttccaatttgccgacgtggtctggcaaacaaagagatttctttgtttctctaagaaacaaaggtttcgtaagagaaaccttaagagatgataaatacaattaatagagagatagccaggcaaggtaagagaatgcttgactgttttaactgcttatcctgtgctgtaacagcttacctaagagatgtcagagggacggacagaaacctatcagcgctcaggcagaacaggtgctccagtggaggcaaggactgcgcctgcatctgtccatgcagaaactatgttctcatggatacaggctgatgatagtaaattctggtgggctatttactggtggagtgtctgttcccaaagaaaattaattattaaatcagtgtcaacttagagagatgtctctagtggtctgccgcagggcactgtctggggcactgtctgaggcactgtccactctgccacttttaacagtgctttgatggcctggggcacacagatgacacacttatctatgtgtgataacgctcagcctagaggaacacagaatgtattgaataaagggatctgattcagataagtgggcataatggaaatttagcaaggtgatatttaacaaaccgcgagcttaccttaaaaataaaaatgaaatccccatgagaatggatggggagaatgtaataaacattagtacaaataagacttaggagttttaatttaccattaataatagtaattgtaataatgataatagtaggtagcacttatcaagagtttatcatgtaccaagcactgttctaataatttaaaacttatcattagaggctgggcatggtggctcacatctgtaatcccagcactttgggaggctgaggcaggaggatcacttgaacccaggagtttgagaccagcctgggcaacatagcaaaaccatgtaagtatgaaaaattttaaaaattagctgggcagcctggcatgcacctgtagtcccagctactcaggaggctgaggtgggaggattgcttgagcctgggagactgaggctgcagtgagctgtgttcatgccactgcactgcagcgtgggtgtcagagccagaccctgtctccaaaatataaaataataaaataaagaaaattaaaataaaatatattattaactcatttaatcttgacagaatctttagagtaccttattggtatctccattctataggtgaagaacagatgtaaagtaacttaaaatgaatcaataatgtaatgtcattgtcaaaaagtattaatgtgatcttagagaatagggtccagaacatgagaattgataaagcttctctaactgcacttaaattattgtattctgttttgggcaaaatggagccttgaggaaaaaggttagcatgaccaggaatgcaaccatatatatatatattttttctttttgagatggagtctcgccctgttgcccaggctggagtgcagtggtgctatcttggttcactgcaacctctgcctgccaggttcaagtgattctcctgcctcagtctcctgactagctgggcttacaggcttataccactatgccccggtaatttttgtatttttagtagagatggggtttcaccaagttggccaggctggtctcaaactccggacctcgtgatccacccacctcggcctcccaaagtgctgggattacaggcgtgagccaccacgcccggctccaggaatgcaaccatttttaaagaggaacaatgaatagaaaagtctgatggatttatggctaaataacagaaagaagggtagaacatgagagtttgagtgaggacttcaaacccttcgtaaagttcagtttaaatagcatgaaacatatgccctgctgctttggagtgtggccatgaaaataatagcaaacacattccatggaatatttactatgactttcccagattacaaagtacaaggattagatgtggaaaagaataaatagaagctcaataaaaagcaaagctttctagtgggattgctttgtgagatgggaatcatgcctcactgaggatgtgcaggcagtggctgaaatcagatgacacagggcgaagggacctccccggatctctactctgtgagtctataaagaataaactgcagacactattttggtaatagatcaacataagaaaatttaaggctagaggtcaattgtggtaaccaaactaaatgtcctctgaaaaggcctccacctgtacttctaagtgtttccataaaatttagtaaatattggccaggtgtggggctcatgcctgtaatcccagcactttgggaggacgagaaggatggatcacctgaggtggggagttcaaaaccagcctggccaacatggtaaaaccccatctctactaaaaatacaaaaattagctgggtgtggtggcgcttgcctgtaatcccagctactcgggaggctgagtcaggagaatcacttgaacccgggagggggaggttgcagtgagctgagatggcgccattgcactccagaccctgtgtgtttattcactaggctatcccctgcccacccagactccatcatgaaatgaaaggcaggcatagcacaatattagtcagataagagtctcatattatgtgggaaccatgccattttatttctgaaacagcaacttcattgtgaggcttagaaatccctgagctttgtggcaactgaagacctgtcaccgtcaccgtagctggagtagtgagcaacacgaggtggtgggacaaaagccattcctttaagtgtcctctgtacctgacaaaagaggacatcaccaaagacctagcatacagttggtactcataaaggttggctgaattgaggctaattttctagctgcagcaccagtcctgtttataaaaaccggtcaaatcaatcttctacaaggaattgaacttcgagcactttgaagtttctaaatggaagtctgtatgtttcatcaagcttaaaaaacagtccaaggcattgatgtagcaaggcgttatggtgtcatagaaaggaaactggacaaagagttaaaacaaaaacggatttgaatcatggtctgtctcgatgcctcagtttcctaatgtggaaaacaattttatttttcacaagattctaaaaatccaatataattgcgttaggtgaaaagcattctgtgtacggtgacaagttatacaagtataaataatcaatatcattactaacaattacattattattaattgaatgagtgtattcacccattaatcattaccaatccattattacatgtgtattattaatgattattattcaattattatatgtattcatttattatacatgtaataattgagtaataaattattcaattataattaataaataatagttaattattacatgtgtaataattgaatacatgtactaattgagtaataataacaaatacacatgtaataactggatacactgaaggaagtgtattcacttatggtttataaacattccaacatcagatatgtaatatttgcctctttgtcatttagaataatctgtatcactagtcaagtgtttgtatccaaaacccaggaacagggtcgacttcgtgggtgtgtcacctgagaggtgacacacggttccaagcttaaagggccttgtgcttggtttaatgctctgctgtttccatcctgaaattcttattagcgtatgcatttttattttgtgctggacctcataaattatgtagccagtcctgtggtgtgaataaaagctgaatctgaagctgccagggtaggagagttggaggaaaaggtgggcttacaggaggaagctcctagctgtctgcacaggagggtagtactcagttgcatctgactgcagcactgaataagaatctcagggaccttggatatcattcagacccatctctcatttcaattgaagaaatcaagagtcccagattttcggccatttgcccgaggtgcccacctcaccagcagggtgtcctctacattctgtctaatgaatgaatggcctgccctggaacataagtagggcttccgcgttgttgtaggacagctttgtgttccagatcacagatgtctctttcataagccacacctcctcccactgctgtgtgggccacagctccggttagatgataactctttgactttttctcaaagtccctgaaatcagtcacagagaaaatggactgatcctttacatcaatctgagtgtccttgtgcgtgtgtttcattttgctttctattcatcctcaatgattgccaacctgcttgtgagatgtacctgagaataaccttcagacaaacgcagtgggctctgcattgatggtgctgattcagaacacatttggggtgttgtgtcatctgtctattagaatgcttccaaaggatgacgactcactgatagataatgttttgtttacaagcatgtccttgggtatgagactttgtagtgtcatgactgaccgtaaatctcactggcagtagcacagcatatgaaacaccttctgctctagtcattactttatgttcatcacaaacaaatcagaacaaattctgaatgcgaatctcctttcaagttagctgactcaggctgtcggaactcatgtaaaagcgaaccaaatatgacaggaggtgaaagctggccgtagaactggaaacggcagaacgtcattgaagtctgcctaagaactagtcagcatcccacctgcttgctcacagtcacactcaacatctctgtggaatttttagtgctcttttttgtattagtcttttagtcgttaccctagtgactctgatatgcattcctaacttatcagtttactttgaattaacattagaccacttgatatataatgtaagaacttcttacagtgtaatttcatgtacagacttcacaatccttttgttgtagctaaagtttacttctacctagattataaactccacaatactttgtcattaatgtactttatcaggtatgaagattcagttaattttaaataattttttaaaaagaaaaatactctttttcactctgatgcccaggctggagtgtagcagtgcaatcactgctcactgcagctttgacttcccaagcttaagcgatcctcccacctcagcctcccaattagctgggactacaggtgtgtgccaccatgcctgggtaattttttctacttttagtaaagacagggtctcactatgttgctcaggctggtctcaaactcctggactcaagtaatcctccccccgggcctcccaaagtgctggaattacaggcacgagccaccatgcccagcaagaaaaatagcctttatatttatctatgtattaacaatgtcttttacttgcctctccagtagatctaattttctatctggtatcatttcctttcagcctgaagaccccctccttgagcatttctcatgttatagacctgtcagcaacaaattctctcggtttttatttatcttaattttttttattatgccttcattttaaaaacattattttctttaatatagaattctagactgacaaggtattttcagccctagaaacttatcattccatgttgcctggtctcaattatccaatgacatgtcaattgtataagctagtttaaacaattcttgtcatttttattcaatatataatgttttttttttctttggctgacttttaaatttttctttcaacctttggacttcagcagatctgcttaaggtgtggttttctttattgactgagattcttgaatctgtgggcgactgttttaggccaaatttggaaaattttcagccagaatttcttcaactatttttttcttcttcattttctctcttctcttcatcaaggactacagataaaagtatatcagatcactctatactgtccctcagatcattgagaatgtgttcattcttaaaatctttttttaaatttgtgactcattttaggtaatttctattgattcgtgaccaaataaactgcttcttttgttgtgtctggtctgctgttaatctcatccagtacgttttttaaagcttcatctattatatatttcagttcttagatttacatttgctttatttttaaatttttcttatttttcttgaagttccccaattctttatcctaactatggatactataactttaaccattatatctattttttcctatggattctttatgtgcttatcatagttaatttagagtacttgtctgctaactccaatatcagaaatatttctgtaaaattattttttcttgactatgtctaataatttttagagtgccctggtcaaaataacttttgattgtatagtggcactgtggatgattcattgtaaaattttagaatccattatctctctttgaagagtattgagtcttgtactagcaggcaattaaattactaatgaatcaccctgactatgctgagacttgatgtgtttcatgaggatatgtctattttagttatgccatctctcagtcttgatacatggtatttattactaggagtggcccttataggttttcagtgaaaagttcaacatagttatcaatgccctctaacttcacgggactcatacttcaaacgctggctcttagcaacaggaagtagttgaaatctctgttaggctctttcagccttctgactgttggtttcctctagggctccttgactatttcccgaataaatgagcaggtcaggagtcaaccaaggacttgagaggagtttacgttcatattgtgcaacccctccttctatgtctctctcttttctagtatttcctcccccagtttccagctgctctggctgttctaaacttcctttctgactcctcaggcaaataggacttcaaaaattttttttggcctcagttctagccacccaagagatattattcgggaagtcctcgtaggggaaaaaaacagtgtgtatcttaaccaatgtcattcccttgtttgaagcgttaaatgccctctaattccatctgcatttggttgctttcattaacttgaaaattctctttctatttttccccagagtttataattgctatcagtagaaggcttaatcttatacaagcacttctaccatctccaagaccagagtgctccattggtttaatgtgtaaccatgagtgaacaaaattgttttcaaaaaatagacaaacctcactgaacctcaatgaacactgaaaagtaagaataaaggccgggcgcggtggctcacgcctgtcatcccagcactttgggaggccgaggcaggaagatcacgaggttaggagatcgagaccatcctggccaatatggtgaaaccccatctctattaaaatataaaaaaacgtagccgggcgtggtggcatgtgcctgtcatcccagctacctgggaggctgaggcaggggaacaggctgaacctgggaggtagaggttgtagtgagccgagatggtgccactgcactccagcctgggtgacaaagcgagaccctgtctcagaaaaaaataaataaataaaataaaaataaaaaaaggaagaaaaatgagaataaaaagaggtaaaacatggcgtttcatcttataaatttaaaatatacctgatttggtactgaatgattgtaactaagtttttaaacagtgttcatggcgtgactgtaaacccagctcacttttagaaaaacgtttttaccaacccaaacagtatcctactcaacaccagttatatttgtgggaagagagatagagttttctggggaaaggcccactcttctaagaaaatatatggttttctttgcattacttttccttctttattccctattcacgctattgaacatgtctatcccaacccttttttctggtcacataatccaggtctgaccacttggccttcttcttctcaatgtaattgatttaggaatgagtttgtggcccaaacaaatggaaagagatataatcctgggaatctgaatgaaataattggtaagataaagttttcttttcactgaggtagacagtagaatataaacttggaactggtatggccatcttgtcatctcttgaagacagcctgcctaagaatgaaaatcaatgctgagaaatataggacagagtcctgacaatgtcagttaaacctgaatccagcaactctgatagctatccctgattgcttagttatttgagccatttcattattgttaattgcccttacagcattttcagctgagttggtgttgtagaatgaacatttgtgtcctaccacaaattcatatgttgaagttctaacctccagtgtggctgtatttggacacagggcctttagggaagtaatggaggttaaatgaggtcataggggtggggccctgatccaataggattggtgtccttataggaagagccactgagcttgctttctctctccaggtgcacatattgaggaaaggccatgtgaggatatagtgagcaggccacctgctatgagccaggaagggaccccctcaccagaaacagaattttctggctccttgattatggacttctaggtttcagaactgtgagaaaataaatgtctgttgttgaagctacccaacctgtggtttttgctgtggcagctgagcagactaattcagttggggtcacttaaaactatgagtctccagtcatccaggaagtaggggtgcaaaggcagatttgtactgtgaccctgtcatggcaattcattctactggcaaaaatttccctcaattaaaacccaaatgatttcaaaacaccccataataggatcagcaagagactccaccaagactgaaaatccactgtgccaacaaaagccttctaaatgcacgttttagactttccttttaccttttcaagtggctcactggcaaaaatcaaggttctaattaaatctaaagggctatccaatcacacggttggcaccaattactcatttaactatgtatgtgttaagcataagctaattgcctttctctcaaaccagagccagttcagatcaggccattcaagagcatttaaacttggcacaagagggtagcactgaaaactgacaataaagaattctctcttgcaggagaacctttcaggaggctttcaatcaatttttgcaagttccaaaactcaaagaagcaaagctaactatgtagctggtgtatttctttctagatcttgaagcattaataaaaagatggactcatctgagaatcaaatatctggtgaaactatacataaatagatatatttgtgtgtctgtgttcatgtgtgtgcatgtggatatgtgtgtgtgtgtataattgcatgatgttcttcctcaccttcaaattctgacagattctaaggaggaagggcacagatgtgtttcctgcaaaagagccccgagtatcttttttcacctcccttccttccctttgtccagatgagaatctttgttttaggggaaatggaatttaatatgtaaaatttattctcagtgagtttcaccaaaataggaaccatatctctaaccttatattattattatctgtacaatacctgtcaaacggagcccccagtaaatgctgaaagcacttcacatccattgggaaggtgagtgcatttccctaacgtattttagagtataattaacacacagtgcctaacagagaaaatcatttttgtgtgttcagctaaacactcaactccacataagttgcatttgatatcgggttcactcggagaaatggctctcacacttgagcctgtgtcagaatcacctagaggggctgttgaaacagactgctgctctgggtcctttccccttcccctgggtttctgactccttagacttaagtgggggggtcccagaattacaatttttgtttgtttgttttttgagacggagtctcacactgtcacccaggctggagtgcaatggcgcaatctcggctcaccgcaacctccacctcccaggttcacgtgattctcctgtctcagtctcccgagtagctgggattacaggcacacaccaccacacctggctaattttttttttgtatttttagtagagatggggtttcactatgctggcaagactggtcttgaactcccataattagaatgtttaacaagttttctggggatgctgctgctgctggactggggaaccacactttgagaaccattggctaagaagctataggacaagagaggcagcttgccagcaggaaaggcattaagtgctctgctttctgggggagttttgcagtagttcacccactgtcaggagctacaaggctcacatccagctggtgtgagggcatcatgacttaaaagctacatgcctcacatctcttgtaataacttcatagacatagtgatgcggtttggctgtgtccccacccaaatctcatcttggatttccacatgttgtgggagggactcagtgggaggtaactgaatcatgagggcaagtttttcccatgctgttcctgtggtagtgaataagtctcattagatctgatggttttaaaaagaggagtttccctgcacgagctctctctctttgcctgctgccatccatataagacgtgacgtgatcctccttgccttctgccatgattgtgaggatttcccagtcacatggaactgtaagtccaattaaacctctttcttttgtaaattgcccagcctcaggtgtgtctttatcagcagcatgaaaacagacgaatacacagagcttgcagggaccccactagagatgtgccagttacccgagtcacagtctgagatggtcagagttatggcttcctttcaggtatttacaggtcacccagtacaggaatgacacccattagtaccaatcagggatcactttacaatgttgcctagtgacaaagttgaaacataccacctttgtatgtttgcagagaaacagagctagaaagataagatcaaattttcatgcagaaggggaaagaaagcattcctttgttaagcctttattcacaaggtacatatctttactcacattatgcccctattttaaaagcttaagaaatgtaaacattatgtcaaaaatttttcattcttggtttagctgaatctcaaagccaccagttggaaggatcatgccaatcaaggaagcagatggcttgctttgggcttcttcaacaaaatcacctagatcctaaattgctgtttctgtgacaatccatattgtctgtttctgttgcacatgataccacaggatttgctaatctctaacctaatttgtaaataggaagtaaatttctacttcagagcttctatcatctagtttttcttcacctgactgctatatggtctgcttcattttgttatgttgcttacttgaaaagaccatggagaaaatgtatttgttatttaaataaatacccaaatttgcaactccagatcttaactctgctaataaaagaaacttttaaaagaaacaatcttggcctaagtaaggaattcttacccttgttacataaacctagagatctaaagaagtaattattagccctggttgcattcacttaaagatctttttaaaaatactgacgcctgaaccatactgcaggccaattaaatcacaatgtctagagagatagggtccaggcacagaatgttcttaaagctccccagataattctaatgtagagccagcgttaagaacttttgaaactaaagtctatcactgagagaaaattatttttccttcctgtcacccttcctccccttctccttttttttaagaaagaaaatactgggaaagaaatcctaggctgtaattatgtgggttggttacagctttctttacaaacactcctgggttatcagaagaactgctctaaccttggggcaggtggactcttcctataatgacatgtaattattagtattattaatacttttgcaatcatattaataattaaggttcttttgcaataaaaaagagacatgggccaggcaggttggctcatgcctataatcccagcactttgggaggctgatgcaggaagactggcttgagctaagaagtttgaggccgcagtgagctatgtttgcaccactgcactccagcctgggtgacagacagagagagagagatgaaaggaagaaaggaaaggaagaaaggaagaaaggaaggaaggaagaagcaaggaaggaaggaaggaaggaaggaaggaaggaaggaaggaaggaagagagagagaaaggaaggaaggaaggaaggaaggaaggaaggaaaagaaagaaagaaagaaagagagagagagagaaaggaaggaaggaaggaagaaaggaaggaaggaaggaaggaagggagggaaagaaagaaagaaagaaaagaaaaaagaaaacaaaagaaggaaggaaggggaaaaaagaaagagagaaagaaagagaaagaaagaaaaagagacatgaatctaagctaaaaaattagacaaagattaggttctgcacttcagtttaaaaaagaagaaataagtacgcaaatctatcatttaatgagagcaaatatttatgtctccatgtcttaaaaatgcagatgtggcatagactggcgagatgctcacccacctgtttcctttcttcctgagcatgtgcctgaacatttcccagcttcctttgtccatggatatagtgacgtgactgagaatagtcagtggaatacgggcagatgtaaatatcacatccagagctggtcaatgaagcctacccatacatgactgtgatagttacttttatgtgtcagcttggctgggcgacaacgcccagataagtagttaaacattattctggacgtttctgtgaaggtacttttgaatgagattaacattcacatcagtgggctttgaataaaacagattgcctacaagaatgtgcctcatccaatcagttaaaggcctgtatataacaaaagactgaccacccccaactgaaaaaagaattctgtaggagatggccttcgaacttgaatggaaacatctactcttctctgggtttccaaagttctggcctattctataaattatagacttgctagcctccataaacataagccaattccttaaaataaatctttctttcctttctctctctctctctctttatacacacacacatacattttatactcacacatatacactttatacacacacacatagacatacccgtattctattggttctgtttttctggagaaccctgactaatacaatgaatttctaggaagaactcttaagaatgaagaaagaatttgggtttctttgttggaagtcctcttgccaaccagggacatccacatggacttagcatgaatgggaaataaactttcattgtgttaagctactgaaatttgtggttgtgattgttatagctgccagcattacttgatctaactaatatagcagatggtgaatgagatggttgttaatttccctttatcgctgacattctaaagcagtggttctcaaactcagctgtgcataaaaaaatcttaaagctttgagaaagtactcatacttggtctttaccccgaaattacgatttctttggtttctgaggtatagcccaggcactggaatttctaaattctctccaggtgattctaatatgtcaataatttgaagaactactgttatacaggatgactgagaccagagttaaaagttcatggataagagaaaccaagagggttctgttggtgaaaggcttcatctggatgaatggtatgattttctggcctcaaagcagagctcttgagctatataattatcgttattattaatagtaccaagaggatacatgcattatcttactaccttgctaaattctcacaataaaactcttccataaatattatgattctcacattttaaatgagagaagcaaagctcaaacagagattaaggtaacttgctcaaagtcacacagctaaggagtagagcccatgctcccaactctaacctgtaatacctcccattatcctaaagaaaatgctatcccacccccagccccccaccccctgacaggccctggtgtgtgatgttcccctccctatgtccatgtgttctcattgtttaactcccacttatgggtgagaacatgcagtgtttggttttctgttcttgcaatagtttgctgagaatgacggtttccagcttcattcatgtccctgcaaaggacatgaactcatcctttttgatggctgcatagtattccaaggtgtatatgtggcacattttctttatccagtctattattgatggacatttaaataacatatagtttcccaagccatttagcaggagaacctgctatagatcgagaaccactataattgagaaccactgctttagaatgtcaacgataaagggaaattaacaaccatctcattcaacgtctgctatgttagttacatcaagtaatgctggcagctataacagtcacaaccacaaatttcagtagcttaacacaatggaagtttatttcccattcatgctaaggccatgtggatgtccctggttggcaaatgtcctgatttgccaagatttgtcctgataaagaaaatgtcctgatcaaaataagtaagaatcacactgtgcaacttgctgctcagatacctgaaatattgcattcaattcccagagtcccagtttaaagaagaagatagtaaaattgtgttcagagaggagcaagtaggttgttggaaagcctggcaagcacgaataagtggaagagaaaggaagggttagatcccagaaaggcaatgctaaaaaagaaggaatgattaaagaaagagaacataatagcgcattcaaatattgtaaagtttgtcacgtgaaagaggaattagcctgttctccctttgtccagagggttaaatcaggatcataaattagacattgcaaaaaaaaaaaaagaaagaaaattctgtttggtataaagaagaccttctaataattagagcttttctgaaaactagcagggttgctaggatttaatgagaaaatatgttctgtaaatgcgtataaaacactgagtatttttgttgctattatcatgtaggtgagtgttccattcattgaaatgtgcaggtacatactgaaatggtggttctgcacaagataggaataagttagatggtcattaaggtccattctaatcctaagattttatcctcacatatcttgggtccctccaaaaaaaaaaaaaagtgttttataaaatgtcttgtctaatgactggttgactggtgaccaatatatatatatataccatatatatatttctttaatttattttttaattatactttaagttctggggtacatgtgcagaacatgcagttttgttacatagttatacacgtgccttggtggtttgctacacccatcaactcgtcacctacattaaataattctccaatgctatcccacctcccagccccccacccctcaacaggccctggtgtgtgatgttcccctccctatgtccacgtgttctcattgttcaactcccacttatgggtgagaacatgtagtgtttggttttctgttcttgtgatagtttgctgagaatgatggcttccagatgcatccatgtccctgcaaaggacatgaactcatcctttttgatggctgcatagtattccaaggtgtatatgtggtacattttctttatccagtctattattgatggacatttatataacatatattttcccaagccatttcgcaggatatgcagtctatttcttcccaccataaaagttaaagaaaatctacagcaataatttggtcaattgtggtttactgaaaacttactaggaggctaactttgagatattcactttacttgaatataaatatcacgaagtacatatagtggatagagtacttcctgagacagcacgaaggcccatgtctgtcccctttagctcctcccatagtcaatcattgtgttgagttgttcagtctgcattgtctcatcttctccatggcaagcttttctgaacaggtccactacgctttggtattctctccacagtatagctcagtgattgccacaccacagatgctcaacaaaagtttgatttggagatgacctagaccctacaaaagttgtctgtggtcctgcactcacagcatgataactgagggataatgtacaaggaaaaatgtgttttttttttcttttaaaaaaattttatataaatgtaagggatacaagtgtagttctgttacatggatatattgcctagtgatgaagcctgggctgtcagtatacccatctcccaaatagtggacattgtatccgttaagtaatttctcattcctcatcccccttgtaccctcccacttttccaagtctccaatgactattattccactctctgaatccatatgtacacattatttcactcccacttataagtgagaacatgtggtaagcaaaatacatgttagatatatctctgtaatgaaaggaaaagtaaaagaatcagtcttaaactactgaaataatttatgcatttctcccacatgtggcaaatatatcaactctctttaggtataatatacctgacctcattgctgatagcataagagctttaaacaaatacttattcaatacttagctttttctctcataaaatggaacaagatatactagggtagagaggacgcttctcacgttcactgctgtatcctcagcacttggtacatagtgtttgcatcacaaatactggctggatgaatcagtgaatgaatgaatgaatggggaggctatggatgtgaaatgtttgatatgccttttagagagatattacaggcctttgagtgactatgatatttccaccaagcttctcttttgagcatataacttagtaagtatcttaaagttcatgttgacagagagggtgaaagtatgaatactttcttgagcttggttatttctaacttgttaggtacagttatcaacagtgataacagtccagcctgagctagatataaacaagaactgtatgccagctttcaaattgcagtttccatgataagctggctctgttttgctgccactgaatagagtgccatttagcagtggtgagagtaagaaaaagttgatcctttggtactaaacagttgagacctactcaagggagctgacattttcaacaccacttgaaacttgggcttggagccaggagaaagtttacacacaatcaagagggcactgctgcatctgcaaaagcagtttcctgtagctagatcgtaaaccaagagtgatggagatgagagcacccaagttcataaaaattccctaatatgttcatttgtaaaagaagaaaacaacattggccaaagaaagatgttctcctagaaaaaggaaaagaaaaaaaggaaatccatcttaccctctaggtgaaaaacacaaataaaatgtccgcgggaatattaaatgcttttccaaaatgtgcaaaacaataagcttcctactgtcctggtgtgcaacgtttgagaggaggctggaagaaggagcattcttgtctatgggcacctgcttctgccatgctggagagaaggcaaatctcaaagggtctggtagttaggatgattggatagagtgatatctctatctcagtctaaaggattggaagtactacacattcttccttcatacagtccaccttttctgagcacctgttagcagccaggcagtgtagtaggaatgaggagataatcagttagccagaccacccctgcactcatggatcttatacaaaaacagaggtaaaagacaatcaacaatggactgattccattacaatgatggtgttagaagaagaaatagtactaggaatttacatagtggtgaaatctgacctacttcattccatgagcaggtgacaccgagctgaacattgatgcataagcagaaactgacaaaaggaagccattgccaccattgataggaataagaaataactatttcccaaattctttatgttatcaaattattctccacacaggtgttttggctttgcttttttaaattctgaagtctgaagtttcagaaactacattgtaattgaaaataggtactcccctctttttttctctgatgctttcattaaaaattctcatcatctttttatgttacttattcggaccttaaaatgtataaaaatatgtgtggtttttgctttcagaaggcacacttgggatctgaagcagcaataattatgaactgacaatacgaaggttggctggctctgatgaggaactccaaggaccttaaaattcacttatgtcaagaggggaaaaggaggaatctaccatagcaaaataagacccttgtacaggatacacccacgtgcacacgtgcactgagagaaaatgagagttgtagggggctgtaggatcctgactgtctcatgcctacagtgagaggttcatagagattaaagagattgctcaggttgtccagcttggaagtgacaaaggctgggagtgctgaatactggaatgtaatggaatccatctacaggtaaaaagcctatggcaacaattagagggagaggtaaagtctctgaggcggcaggcaattggtacggagcctgaaagcccaggacaaagttttatttgctttcaagagcgaataggctcacacctataatcctagcgctttgagaggctcagatgggaggatggtttgaattcagaagttcaaagccagcctgggacacacagtgagactctgtctctaccaaaaaaaaaaaaaaaaaaatagaacaattagctgggcatggtggtgtgcacctgtagtcctagaagctgagatgggaggtttgcttgagcccaggaggctgaggctgcagagagtgagccatgattgctccactacattacaccgtactcctaggtaacacagcaagaccttgtgtcacctccagaaaaaaagaaaaagccttaacaaacagaagtgaaggtaccctgagggaatattctatttggctggggactccttatcatgattttacttagtgttgcagcatattgtgttttctgaaggtaggtgttccccctcaatctttctcatcccaccggcccttctccaatgtgaccttgccattcctccatcaagaagggaactctaacttgcctccctcttcagatctaggctaccttatgagttgctggtagccaacaggaggtggtggtgaaagtgacactgagtgacttctcaggctatgccagaaaagccatggggcttgtgcttgattctcttgggacactggctctggggaagccactgaccatggaggtgactgactagcctgacgctgctattttgaaaaggccacatgttgatgctctagtcaatagagtatcaggtgagcccagcgttctgtccaccccggccacaatgccaaaacacgtgaatgaggaaatcattgtagaagtgatctcctcccagccatttacgtttccacctgagcccctagaaatcatggagctgaaataacatgccctgtctaaattgctaacacacagaaacggtacgcacaacaaaatcacataaatatagataaaatccactaggttaaaaggagtttgttacacataaaaaaaatgactgaaataaatgttatattatctatctataaagactactatgggcattgagcccgctgaacagataagaaacccaaggtacagagagataaacccaactagatgatagaatcataagtagaatcttataaatgcagcaataaaatgatcataaaagtacatgtgaggacactgagtttcatagaaaaatgacttggatccagatgcacagttaataaaggcagatccaggaaaagaacttagatttcctgaagagtgctggagtctgaagctctttccaaaatattagatcaagcacggggtagttaaaaaaaaaaatcacatgctttggcatcagatctgggctgattatatccctgaggtaagtttactttatgcctggttgcccctatctttaaatagaaagaaaacagagaaagaaaaatatgaataaaacaatgaaatttggaacaggcttgtagtttaataggatcgtactaacgttaattacctggttttgattattcaactatgattacataaaatgctaatagcagcagcagctgagtgaggggtaaataggaaacctctgcactatttttgcaactttttgtaagtctaaaattagatcaaaataaaaaattaaaaaaaaaaaaaagaaggaaaaaccatacctaacttgtggggttttaaaaaacaaatttggaaaatgcaatgcctggtactttaaaaagatttcagatataattctcctctgcttccctcattccaactttctgataaagccagaacagatggcccacggacttctggttcagaccttgctccccaagaaaaagtcccctcatactgcaggtatatgccagcactttgcagctagaacacctctcagaaaatgaatcgaggaagcagacgatgggaaacttcccacggtagtgaaatctctaaacctcttctctgacctttgaattcttggcagccacaagctacgttcttgccaagagtcctcacgcgtgtagcttccacatctcctcgccctcatttagagggtagacttcctccacactccagtcatccggtgccatctgtctgtggccatgaattagctgaaagctctccgaaaccgccttctcaagctaattgagctgctctaaatatttgaagagacagaaatggggttataccagagatggtttaataaaatattgaaagagcttttttctaacggtgtagtagtccacttccttctttcctcccccagggaaatatgcatcttatcagtttatcatccgaaatgaacttgactggtctgggaaatcggccacaccgtcaggggagagtgaaggagaaacttccgggaaatgatcagaactattttaaaatcattttgctagtgcaaatcttgaacattcataaaacttatctatgaagataaagactgaacataaagaatagcaatgggcttggcctcctaccttaaaaccatagagattgactgtgttaaaatatattgttgaggatctgtaacaggaaacagataacctcggaagttcagcgtgaagggctactgcaccacagtcagcttctggctacaagaggaggagtccatcagttcacaaaaccaatgacttccatcaatttatatttaagtttttttttttcactgaataattctgtccttctaatataaatctgacttttctaaccttgccttatacttcttggaaattcctacttaatatgagtccatataatcagaaaacatgatgaatttggggcacaaaaactaatttttatttatttatttatttatttgagacagagtcttactccatagcccaggctgaagtgcagtggtgtgatctcggctcactgaaaactccgcctcccaggttcaagtgattcttgtgcctcagcctcctgagtagctgggactacaggtgtgtgccaccacgcctgactaatttttgtatttttagtagagagagggtttcgccatgttagtcagtctggtcctgaactcctgacctcaactgatctgcccaccttagcctcccaaagttctgggattactatcatgagccaccgcacccggccagggcacaaaaactaatttttctactaacagttgctgggtatgccatggggcccatcaacaatggagcccactttgactcacagttctgtgctctgagtgagcaaaaacattaacctcaaggcctgtacaatgcctgagcattttctgaatcattaagtacaatgacgcagggaaagagaggacaggaagaaggctgggaccaggcccccttcaccctagtgttctgtcctaggaccgtgagtacagctgcagtcttaggtgtgcttgtagatcgggaggaggcaggaagcttgggaaggaaacagacactttggttgtccccatattgcttctggacccctcatggtgctctaagaaggagagagcaaatttgtctactgagagggacattgtagtggacatcaagatgcaagttagtgctttataaatttatatttcctcatcttttcaagttttacctctgatcatgataactcttttggttgttggtcgtactccctcctgtttcccttgactagtctagaaatccctcctccctaagttctccacccttttctccttttcttcaggccaaaatgttctcaagttgcctttgatgaaactagatctgaaatgacttctagttgattaatttgttcatacaatatactgtgaaactgggcaagagatgatataaacactccttgaagctagctggggaggactctgccactgttttttcattttacaaatgaaagagcctctatttatggcttttgatgacatagaatagtctatttgataaaaattaatagtaccccctctagttctaataaaaaatttatttattataacaatatctttataaatgtggagtgtcttcctcttaatgattttctggaactctagtggtaagatcacattttgattaaccatgcctggctaatttttgtatttttaggagacagggttttgccatgttgggcaggctggtctcaaactctataggcacgcaccaccacgcctggctaatttttgtatttttagtagagacagggttttgccatgttgggcaggctggtctcgaactcctgacctcaagcgatccacccaccttggtctctcaaagtgctgggattacaggcgtgagccaccatgcctggcctcttttcccattttctaattaatcatttgtcttattgagttgtaagatccctctgtgcattctgaatacatgtctttatcagataaatgatttgcaaatatttcctctcaagatatggcttggctgttttcttaacagtatcttttgaaaagcaaaaggttttaattttgacaaagttcagtttatcaatgtttcttttatagattgtggttttggtgttacatctaaaaactcattgcctaactcaagatcagaaaaattttctaccatgttttcttttagacgttttataacttttgctcctctgtttagttctattattcattttgaggtaattttatgtatagtgtaaggtaaggatttaaattcgctgctttttgtatggatatataattgtcccagcactatttgtttagaaaacaatgcttaccccctttgaattgcctttacacctatgttgaaaaccaactgaccatacatataaaggcttattttgggatctcttaattctgttccattgttgtatatgtctattctctctctctctctctctttctctctctcttttgagatgccagagtgcagtggtgagacaatagctcactgcacccttggactcctgggcttaagtgatcctcccacttcagcctcctgagtagctgggaccacaggcttgagacactgtactcagctaattcagctaatttttaaatacatatatttttttttggagagaagggatctcattttattgcccaggctggtctcaaactcctggcttcaagcaatcctcctgtctcagcctcacaaagtgttgggattactggtgtgagccactgcactgggcttatatgtctattaagccaaaaccacattgcctgataaatgtaggctggtcataaattttgaaatgagtggtgtaaatccgctaactttcttctttttcaaagttgcttggctgttctaggtcatttccatttccatatatattttaggagcagtttgtcaatttctggaaaaaaaaaaaaaggcctggggggagcttagatagggattgggttgaatctgcagatccactgcagaacgacagtcttaactacatagaatcttcctatctgtgaacacgtaatgtctctccatttctgtagatctttaatttttcacatccatgtttgtagttttcagtgtgtacttcttgcacttcttttcttacatttattcctaagtgctttgtactttttgatgctatttttattgttatattgtccattgctagcatacaggattaaattattgtagttttgtaggtcattggcttatataaaaaaaatcttataatctttttacaggaatcatatggtgacatgaaaagggttccataatatagtccccacctgctactccagcatcactccccagcacccgtaagtcagaatgtatgtttccctagcactgaacttctaaaaattgatacatgttagatgtccatgtgataatttcatacatttacataatcaaatcaaggtaacttggatatccgtcaccttaattatttatcatttctttatgctagggacattcaaattattatcttctagttattttgaaatgtccaatcagctaatattaactctagtaaatttactgatctacggaacaccaggtgttatgtcttctttcaagctgtgtatctgtacccattaatcaacttctcttccctcctccacactgccattcgcagcctctggtagccaccacactactctctatcttcatgagatccactcgctagctctcacagtctcacatatgactgaaatcatgggatatttgtctttctgtgcctgactcacttcccttaacataatgacctctagttctatccaagttgctgcaaaggacaggatttcatgctttttttatggttgggtaatattccattgtgtacatctaccacatttttcttatcctttcacccattgatgaacacttagattgactccacattttggctattgtgagcactgctgcaaagtacatgtgagtgaggatatcgcttcaatatactgatgtcatttcttttggatatatacttagtagtgggattgctggatcatacggtagttctattttttagtttagtttttttttttttttttaaggaaactccatactgttttccacagtggctgtactaatttacattcctactagcaacgtatgagggttcccctttctccacatcctcaccaccatctgtcattccctatctttttattttaactgggataagattatatctcactttggctttgatttgcatttctttaatcgtgagcactgaactttcgacagtaccctgcaaccttatgatgtttttacttaaatttaatttcaacctcaagtctcagtttatgcattacctcatcctagaagcctttcccgttttctctctacttgcgctacgctgcatacactggggaacgcatgtgtgcatggacactgtcatttctataccaaattttaaactatactaaattttaactaactacttacatgttcatcttgagaaacctgtgtcaccatgtatagcaaaacctgccagttgtttatcgatatccatcttctctttccaaaacaatagaacccctaattttttgctaggcataaagcaaaagaaataaagaccatatttctggccccgcttgccattaaatgcagtggtacgattatcttgcatccagtgagagaagctcatcgggcagctcccagaaaccttccctcaaaaacagccaatgcatatcttgtttttctttttctttttttctttttttttttctccttcttgccagttaaaccagatctgctaaatgaggctagaccagccaccctgagtggatgaagtgaagtgactgtgggaacagagacccacatggggcaaagcaacaataggaggggagcctgggtctccatatcccaccctggtctgcctacttctgggctttccatgagaaagacacacaattctccctgctttaggctgttatttccttgggtctctcttaactgttgccagacttagtcgaaagaggtttataccacatcctattgcatcttcagtacctggtgctgtgccaaacacatagtagttacttaattaatgtttgctaatttactgcaaaaggatagcaaaagttaaaaaaaaaaaggaaaaaaagctttatggaatattaccttcaaatccatcctgctccacatggttaccaaatctctttccaggataataaaatcttaacattttaggcatacaatttggccttcaaaggcctctcagctttttaaatctaatttctattctaatttattcatcatgatgttaataagatgtttggtttttcatgtagaaggaaaagcaaatttatacaatgattccatggatagtcaagagacagaaggcctgtaattgactataataatagatctcacaaaatcataaaactgatagtaacaatggggttcaagcaattaaacaattttgattccacagatgaaaaagctgatgttcagagaggtgacacaactaattccaggccacacaaacattgaatggcagatctgatgtcagaacccagataatctaacttccaacttggtactctcagaatcagttagagtgcctttggttgtcaagagcagactaactaacataagcaaaaatccttttaaaatcttagaatttacaggatccaaagcctggaacaggcaggaaccaggcagctctgttcctgcctggtttccatggcaacatcagctacagagctcatactgatttagctgacggaatgaatgaataaactccaacaacggttattgttctgtttttcattctgattgtagaatgcttctttttcttttcttttctttctctttctttcttcctttatttttctttcttcctttcccttttctctcttttttcttttttctcattctctctttctttctctttctctctctctttctttctctctctctttctctctttccttctctctctcccttcctttcctttccttctctttctctctctctctctctcttcactcctttccaccattatttttgcttactgaatctgcttcccagaacagtggctgatgagaagcctaggcaccaattttctcattcccatttccctcaacctaatatagggagtgagatacaagggtgaacccctaggagatgcactttgagagagagagagagagagagagaaagacagacagagacagaggagaggagagagtaagagttagctctctggctttcctggcttcctctcattttctgtttttatatgcattttatttgttcacatgtttttaaagtctgcagtttgagaccatgagatgacaaggagagaactgaaagccaaacttttgagaatacttaagagaaagttaccaagtgcctgagtcttctatgatatcactgagcaaatgacgacctccgccccccatattttagaaacaaataactgaatgcatgaataccgtaaaggaagatgagtacatacatgtaagcacttagagaaatgagaaaccaccttgtatttttatctggaaactaataaaaagcaaaatgcatccaggaatattatacgacatgcaatttcgcaattcaaggtttttctctttcagtgtgtagagttagccataaagcaaattgacagatactgaatgacctagttaaatcttccacggatgctaatatctcctgttaacaccctgcagcttgaccctaaggacttccgcgcacccatcacatgtatagtatggtgtttatttcttgattttatatttttaatatataaacacattggttatggacaggaaagaccttctgtcttattaaatgactcacatgatttgcctcgaaaccacaagctaagtcaaacttgtgctaagcatggtttaatctgacagaatataaagattctaggacaaatcaaacccaagtgaaagtttccagttttattgccacacccaagttcgataaagaagcaatatgagcttgaattaaacttgcagccgagaaaggttacaacttgaatatagtattgagcagaaagaaaactttccatggatcaaggactcaacataattctaggatctataaaaaaaatatccatctgatcttcaatgtgtgtacattctaggagtaaaacctatgctttgttaatattacaaagtaaagcaatcttctttcttcccaacagcattgctttgcccattttagtctgttatgtagcattatccatgaagagcacgacaagggaaatgtacagcgagcccttgttaatggtcttcggagaaaatggtttaattgcacagacaaatgctgagtcaaaggtgattgtgcaagccagagaaggaagaaaagaaaatattttttaaaattagccaataatccatttataaggacaacaaacaatagaagcttaatgactttttgccatattactaaaacatgtaagaattacacgtgacttctggaacacaaaattcttaatcccaggtcagaatagttaattcaaaactaatttgttttcagggaacatatctgagaaataataaaatgtagggtctcagctcacatccacccttgctcagatgaatgatcataaaaatggtcctaggcaaggccacagggtctggctggctgaggactttgtgcactggaccatataccatgagcagtgagttatttcaaactccagctatggggccagaaactccttaggagtccgcaccagaatgtctagaggagcacgtatattaacaagcatattttacacttaaaaaaaaaattaaccacagaaactgagattccaccagacttccttgataggaagataaattgtaaaagttttactgaaggacttaatttttaaaattaagccatttaatttaaaaaaataagacttttaaaacaatgttgagaaacacacccttcaccagaagaagaaaggggcgtggccagggaagcagagcagttccgcctgtacctggtttatgcagtgcacttctgaatattgccttcgaggaaaggttaggacaggataaagcctccagacaccaccgttcgagtataatttgagccaggaaagctgtcagtgcagctttttactgtgttgtagaatcctttgggaaagaaatcttttcttgggttcctctgagaattccgactgaggcaaaaccagatttatcagggattttgcagatatcctgaaacaaaccgtctctcagcgtgagtctaaaactccatccgccaagaccgtcgctgggactaagccctgaagctgagtgatcacttgcttcctctgctcctctctcgtaagaattccttccctcaaaggcctcacaggctagatagggaggcagacacaccagagaaacaacagtgaagcatgcaaagtgctgtgaggaagtgttgtgcaggtattgtagaagctcagattgggagtgcctagggctgaccgacccagacagtcttttatactgggcatgtgtgtgtgtacatgcatatagaaatttggggaggagaagaaaaagaaataaaaggaagtaatagtggctgcaacttctgcctacagatactatgaccttgtatagataatgcttttgtgactatgacttggccttgcttgcaacccaccatctgagtcctgctaaccgaggaccaactatttaggaacaagctacactgtgccaccaaaacagacatcaacaacacctttattacatacacaattgccccaagaatttttatatatactattttcctttgcagcaactttactcaccctctctctcttttttcttttaaaatttttagaggagtttcactctgtcacccagggctggagtgcagtggtacaattatagctcaccgtagcctcgaactcctggggtcaagtgatcctcctgcctcggcctcctgagtggctaggattacacatgtgtgtcaccaggcccggctactaagctactaaccctctcttaaatacaagctactaaatctattgaatgatccgggaagaaacaatatgaaaaataaaaagataattaagaatttcacaaagcaaatatatgtataatgtctagaagaatcaaagatggaaagataatatggtaatatgacactaaagagcctgatgaactttttgatttgttataaaacatttaaaaattttccttcaatatttaattggccaatgagtctccaaatagctattgcctctctctcttttttttttttttttttttgagatacagtctcgctctgttgcccaggctggagtgccctggtgcgatctcggctcactgcaacctccgcctcccgggttcaagctattctcctgcctcagccttctgagcagctgggactacaggtgtgtgccaccacgcccggctaattttgtgtatttttagtagagacgggtttcatcatgttagccaggatgttctcgatctccggacctcgtgacctgcctcccacggcctcacaaagtgctgggattacaggtgtgagccaccgcgcccggccatccctctctctaactcttaatccacattgccatgcattggttccctgctattaacctctttggttctaatctagatgatggcatctgctggtcagtgtcctggtccaatgtggatcccatccagcatgctctccaccttacatgcagagcagtctttgtaaatcacaaatctcatcatgtccccccttcactcaaatgcttagatacagcctttcaggataaagtccaaactttttagccgtctataatctgactcttttcttgttacttgctcaatttgggacatgtactctggacaaatgaactgtgtcataccccaagcacgccatggtcttgtgtgccttcatcttttttactctccactccttaccagggatgaactgcctcccattctcagtctagatccgtggttctcaaggttctcaagggaacagtggcgacagcagcaaacgggacatgtcagaaatgcaaatgatcaggcttcatctcagatctcctgagtcagaaattctggagaatggaccagcaatctgcaaataaggactatagaagatcttataccacagaaaagctaggcagcgtgcagagaactagagggccatcgatgacttctttgcctgcagttcagcaaatacacagcagaagtgaagaccactaggtcacttggtcaagctattcataaaacagaagtggctcaaggagaataaatggattatacgcagggacccctgtagcttgaggagtcagatagacattatagaaacagagactgtcagtgtcccaggggtccaggaggtcaaatagtccagtctcatcatgtcacagaggataaacaggagtcctggaaaggtgaaatgacttactcagtgtgagacagatggccaagagaacactgaaaccaaagtgttttagaaggaaaaagctgcatggtaaaaacagctgagtcatctgatggacactgacacaggcaagtccctcggtgggcacccaggcagaatgagaagcatgacatgtttgttcttaataactcagtgggctgatcctgcagtctaggcaccctgctgacgggaagaagcaacgactcagttagactcacgtggatctgtccagcactggacgtcagcagtagataggtttgatggagctggaaagtttatcctttaaaaatggccacaaatattacacttataaatatgtatgtgtgtgggtgtagaaacattacttgtaaaaaatgaaacctgttagattagatcaaactaggttgccgcttctaaggtagtgaacgtgtaaaagagtaaacctcatagaaacatgaggctgcccaatgcatgtgtacatgttggtgttgtgtgcatatacttcatcatatacatatagttagaaattgtatgtataattaaaaatataatcattcaatcataacattaaacagtgaaattattacatcataatgttaatcataacatggagcaattaaactacagtgttttatgacatatagttttaaattataacattaaaaatataggtaaacggctaggatcggggagcaaatattaaagtaaataaatccctgccctactccctgagccctttctgctcatattttgcactcttctgaggactgatgttggcctcccaggcttcaggacaacctgacatcaagatgcctttaggttctttctgacagctgctgctgcttcttcatcacagagagttcatttgctctcctcggcaggccagagctaattaagaagagaacagcccaggttcaccctcccaaccctcctcatcggctagaactgcctgtttgctgccctccaggtcttctgcagtgagaccccctgcttttctccagagagtgaggaaaccaccactagaggggtggggtctcaacacagacatatttacccaacaggagcagaatgtttccatttgacaattccactacaagaagcaggccttcttggacctcttgcccaacttctggccttctgattctaagtagaagttgtcatttttctatgactactattaggttggtgcaaatgtaattgtggtttttgcaatgaaaagtaatgacaaaaaccacaattacttttgcaccaactagtgctagcaatgccttaaaaaataaattgggctcaagatttcttggggcataaattgttttgtgctgttttccgtttcatctccatgttccacgggcttaaacaccacagagcaaaggcagcacgtgtctgtggagctgccccctttccaaggaagctgctttgaccttcaccttctgcctcctggtagtgtgtgatgatcacatggaatagtaaccagagctgtgtcacacttcacaaaacaccttggggattttgtgacctcaaagtattctcttcacctggcaggtggcatgagccatgggagatcccgacactcccaactttgctaccaatgactcagatagagggacacatgtatacatgtgtctgtgcacattaatggaccagcactggccatgtttctatgaggccttttcttttacatgattaccatttaagaagcagcaggtgaatctaacctattttgttttcttacaagtaatactgtgttcgctttttgaaatttcttttctgaactttagtaaaaccatttgctactctttcactctctttttgtgtttttttttttaatttttaattttgattttcataggttttgggaaacaggtggtatttggttacatgagtaagttctttagtggtgattcatgacattttggtgcacccatcacccaagcagtatacactgaacccaatttgtagtcttttatcccctactgccccccaccctttcccctgagtccccaaagtccactgtatcattcttaggcctttgcgtccttatagcttagctcccacttataagtaagaacacacaatgttcggctttccatccctcagttactttatttagaatatggtctccaataccatccaggttgctgctgctgcaaatgccattattccgttcctttctatggatgagtagatagatagatagatagatagatagatagatagatagatagatacaatttctttatccacttgttgattgataggcatttgggttggttccacattttttgcagttgtgaactgtgctgctataaacatgtgtgtacaagtatctttctcgtataatgacttcttttcctctgggtagataagcagtagtaggattgctggattcaatggtagttctacttttagttctttaaggaatctccacactgttttccatagtggttgtactggtttacattcccaccagtagtgtagaaggtttccctttttaccacatccctgccaacatctattattttttgattttctgattatggccattcttgcagaaggagtaaggtggtatcacacggtggctctgatttgtatttccctgatcattagtgatgttgaggatttttttcatatgtttcttggccattttcacatcttcttttgagaattgtctattcatgtccttagttcactttttgatgagattgtttgttttttcttcctgatttttggagttccttgtacattctggatattagtcctttgtcagatgtatagattatgaagattttctcccactctgtgggttgtctgtttatactgctgattatttcttctgctgggcagatttttttagtttaattaagtcccatctatttatctctgtttttattgcatttgcttttgtttttgtgtgtgtcttttgtttttctcctctcccactcttatccccaacccaactttgatttctctctttattctctagaacgtgaattaaccagcagcctgcatttcacatttaactgaagaagcagaattgatgagtgtcacctgaactatcttgaacatttcatgtcacattgcatgtcagatatttaatcttgacacctcctctccgtccagagccaaaaagtcaccaggaatgaagaattctttcttcatcatatagaattttgtaggccatggaaagcaatctagacattattctaagtgctatagaaaactgtgtttgagttttgagcaggaaagtgatatgatttgaattctacttaaaaactcaggctgggaaatagaagaatgaaagcaaagagaccagtaagaggatttattgcaagaatgaaaggatcacatgactatgggggagagaaatggatgaatttgggatatattttgtgtgcagccaacaagacaaaaattaatgcttgcaaggaggggaaaagaggcatgaagggaaagagatggatcaaagaagattcataggcttttacttgagcaactaaatccttgcagctgccctttaacaaaatagggtacagagggataaaggaaatttggagagagaaggaataaaaagttctattttggccacattatgtttcagatacctactaaacacacaaatagaaacgaaggaaagtggtcaccttattttaatgggaaggcagcaacctgaaaacctagtcatcctggagcatccagcagagaaaatttctattgcaagaagtaaacacttgattttgccttccagacagatcatttcattattcaaagaacattttttttcagaaggaccatgagatatgcaaatatatagcagagatttttcagggtacacaggtgttagaagctaaaagtagtggagcaaggtgacaaaaaagagatcctttctagcgggcagtgaaatgcctatatattattttctttagagcaagattccctttccaagtatgaacttaaactgacctatccaggtacatattattattttcttagaaaatgtgtgtgtgtgtgtacacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccaccaaaaagtgggcaaaggatatgaacaggcacttctcaaaagaagacatttatgcagccaaaagacacatgaaaaaatgctcatcaccactggccatcagagaaatgcaaatcaaaaccacagtgagatatcatctcaccagttagaatggcgatcattaaaaagtcaggaaacaacaggtgctggagaggatgtggagaaataggaacacttttacactattggtgggactgtaaactagttcaaccattgtggaagtcagtgtggcgattcctcaaggatctagaactagaaataccatttgacccagaaatcccattactgggtatatacgcaaaggattataaatcatgctgctctaaagacacacgcacacatatgtttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccattattctcagcaaactatcgcaaggacaaaaaaaccaagcaccgcatgttctcactcataggtgggaattgaacaatgagaacatatggacacaggaaggggaacatcacacaccagggcctgttgtaggttggggggaggggggagggatagcattaggagatatacctaatgttaaatgacgagttaatgggtgcagcacaccagcatggcacatgtatacatatgtaactaacctgcacgttgtgcacatgtaccctaaaacttaaataataataaaaaagaaagaaagttggacttaagaactgtaaaaatgcaaggtgatataatttggatttgtgtccccacccaaatctcacatcaaattataatccccagtattggaggaggggcctggtgggaggtgattggatcatgaggatgctttcttatggtttcgcactatccccctagtgctgtcttatgacagagttctcaagagatctgcttgtttaaaagtgtatagcacctccccacacccccctcctcttgctcctgccgtgtaagtgtgctcacttccccttcgccttccaccatgattgtaagttttggtgatgcctccccagaagcagaagcttgcacagcctgcagaaccatatgccaattaaacctcttttccttataaaaaaaaaaaaaaagaaaacgtgtgtgtgttcaggcctggcacagtggctcacgcctataatcccagcactttgggaggtcgaggtgggcagatcatgaggtcaggagttcaagaccagcctgaccaacatggtgaaaccccatctcgactaaaaatacaaaaattagccaggcgtagtggcaagtgcctgtaatcctagctactcgggaggctgaggcaggagaattacttgaatctgggaggcagaggttgcggtaagctgagatggtgccactgcactccagcctgggcaacacagcgagactccacctcaaaaaacaaacaaacaggcaggacgcggtggctcatgcctgtaatcccagcactttgggaggccgaggtgggtggatcatgaggtcaggagatcaagaccatcctggctaacatggtgaaaccccgtctctactaaaaacacaaaaaattagccaggcgtggtggcgggcgcctgtagtcccagctactcggaaggctgaggcaggagaatggcgtgaacctgggaggtggagcttgcaatgagctgagaccacgccactgccctccagcctgggggacagagcgagactctgtctcaaaaataaataaataaaaaaccgaaacgtgtgtgtgtctgtgatgatggggtgtggatgaagactgggcaagctatctcaaaggcaatcagaaattgacattccccccaaaatccaaaaatagcaggaaaggtatgtaggccacagagtctgcttgagggtgagatataattatagaagggaaggaaacctggactgataaatctatctgtctttttccacttgtcatatatataccaatgcttcactactaaggtagtgaaccgtgatagagcatggttgtgaaattgaaatcctgggaccagaccatgtccctgcgggtagaaggtaaaattccttccaaaggaagtagatatttttactgtctgtgttccaatggagagatccattccagtactaatacgaagtttaagaaggcatgtgttaaactagaaaaaactgaagatgaaaagaacacagcttcctcctaagagacttagaggaagcatggctctggatttcgattgagtactatctacctgtgagtagtccttcgggggtaggcaaagtggattctgcaataaggcattaggccagaagctaagggtctgggtatgttggctttaatagttaccatatctagttgctattataaattgtcctctttgttgtttttttttctattattgaacacactgtaaatcttgtagaattagaggcccatgcttggatgaaacatcatgggggagagcagtagcagtccaaagggagccatttcaggaagtaggggatacatgaacgtcagctgtggcccttgcgcagaactgagagtgctggctagctgaggaacacagcagcaagggaaggaattagtttaacagttaccatctcctagaaactcccagaaatacacagaaagaaaattttgcaaaagactaaaattactgcattcaagcaggagggaggctgggaccattgtacatatgttctttaaaagggaatatgttctcattttatctaaaaatgagacacacctggcacatttgtctgtctccttctgtaggctataagctctttcaaaacaaggacctatcatgtcagaaagacttaataattatttacaaacgaaagaataagggtatccttgaatcaagcctttaatttgaataactcgattggttttacagtagcaccaagttctacttcctcatttacacattgtgaattacaatgctattattatttggaagtaatggcttttaaatgagcctggagttgaaatcgtaggaagaaagtagttctgtgtatgtaaattatttggttgatgaagggggcctgccgctccacacctgtgggtatttcttgcaaggtggagacgagagactgaggggagtctgatctctctttcccccacaggttgaaagagatggttgcatgctgttgttctttaccaataatgccagggataactagccacggagggtcaaagggtagtaaggctttgtaacaactttcttaatgcaatgcaatcatacaggtggtatgcatggccaccaaggagatgcagattggatttaactagaataacctggggactaaccaaggttccttttctcaactaaaaaaaaaaataggtatagtgatgctaaatctctaaatactcttagaaagattaagaaaataattataagatatatgtcctcatgatggaattaaaaatgaatgtattaatgtcttgtattggtagatttgttttatgacccagcatgtaggctttcctgataaatgcttcacgtacacataaaatgagtatgtaatctgcagtaattggatgatgtaaataactctctatatggtcaagctgatggatagtgtttcttgagttttctgtatcttcactaatggtccatcacttgttctgtaaattactgagagaagaatgttaaaatgtccaaatatctttgtgaaggtatatctttctccctttctgtcactttttgcttcatggatactgaaggtatgttattaggtgcataaacatttaggattgcgaatcattatgattttaccctttttatgtctaataagacttcttgtcttgaagcctattttgatatttatacaaccatgtgcaccttcttgtggttagtgtttgcaatgatgtgtatttttccatgaatttactttcaattttttaattgctgtgcatctttatatttaaattatatatgtgcagaatcctatggctgggtcctgttgtagatatatatacatatatatatatacgtatatatatgtatatatacatacatacatatgtatatatatatacatatatatataatcaaataatctctgccttttggaaaaatatattttggtcgtttacatttaatgtaagtattgatatgactgtggttcagtctcccatcttgctggcttttttaatatttggcatctctgatcttcgttactttgtcccttatctcttcctcatttcctgtgttcttttgtgtgaagcagtattttttttaaaatttcttctatctcctccactgcattttaagctacatctctttgtatttttaaattcattcctagagtgaacatatgcatccttaaagtgtcacaatctactttgagcaccaatactaaatgttagggattcaaacacgagcaaggcatatccctccttttcggatgagtggagaaggcagacatgtaagtaataaatacagcaaaacctctcactattcagaggacctttaacatggccacaaggctcaagcttatcattcgacgaacttgctaccagtatttcttggttgtacagattattttttcctcttcgctcactggatttcatatttgtctgaaaacatttcgccctgtttttaactaaattgtgttgtcatttgtatagtctatatacaagtgctttgttggatatgtattttgaaaagattttctcccaatctatatcttgtcttttcatcctcttcacagggtcttccacagagcaaaagtttctaattttcgtgaggtataacttattgattttttttggtttatagattgtgcttttcatgttgcatgcaggaaaactttgtgaaacctaaggactctaagattttcttctatagttttatagtttcaggtttcgattttcactatatgattcactttgagtcaatttttgtatgtggtttatggtaaaggtcaagatttttttttttttggcatttgactatacctaatttatcctttccccattgaattgtcctagcattttgtcaaaagtcattgctcatatatgtcatctatttctagactactgttcccttgaaatattggtctatttttatgccaatactacactgttttgcttactttacaataagtcctgaaatcagtagtataaattccttaactttgacgtctgttttcaaaattattttggcaattccagacctttttcatttccatataaattttataatcaatttgtcaggttctacgaaaaagcctgctgagatttcaattgagattgcaatgaatctatagatcttttgggggagcactgacatactaatcatatcacctcttctgaacatatgcattcattatgatctagcaatctctttctaagtatgtcttagaaactcttggacaagtgaacaaggaaatatacacaaggatgcttctagtactgctgcttgtaacagaaagacaccagaacattttccttatcacttgagaagatagaaaaatggtggcatatttatacagaaaaaaattttggaatttcatgtggcagttaacaatgaattgactcataaacataacagttacattttaaaaaaggaatatatatagtattatcctatcaatattacattaagaaatatgtaaaaccaatcacatgttgtttgagaaagcaaatatatgtgttaagactatacagaagaattaggaaattataaatacaaagttcataataaaattcataatgagctttttacaggatggggaaagcaataaccttgggagggccacaaagttgtatttcttaatcttgatggtgagtacacagaatgttatcaaagtgttattctatacagcatatatgtattttagtatatccttttctatttaatatttaatatctaaatcatttttaaaaggaaagacagagaattttatcgagggggaggaatcagagtaaacttaaatcttacactagtgaaacagggcacaagcatttatggttcaattgtgtaatcgattcttcatttatactattccatttgcagcttatgaactgcaaaacagcatcctgaataaatactaggagtcgccaatgtaaacctgttaatattgtgggatttttttttttttggacactcaccttctgcaaagtaacaaaagcactttaaaatgtgagaataaatgttgttgattgcagaagaataccagggaaaatagcacaggccatgcctttctctcttactcctcctattgggtctgcaggcctttcgcttgcatgagtcatccatactcaggtaagcactgtgcctttattctttattgcactaggcctcttgacaaatgactgtttaaggagtgtttgcacacctgtcaatggttcctgtcatttgtcaagtaacaaatataaaatctgataactaaacaggagaaaacctgtataaaccaagaaatattggtaccataagaagttcaacagatgataaggctaagccctgtggctctctggaagcccctccgaatagtgagtggttctgctgtatttgttatttatgtgtttgtctcctctgctcatttaaaaagtagggactatgccttgctcatctttaaatccctaacacttagcattggtgctcagtaagtgtccttaattgatggaaactgatatctgttgatcccaaataaaaacaggtcaaagccatctttcacggcatattttcaaaccttctgttttcgcattaaatcgtgaaccttttgaaagtatctacacacttttaaaatattttggaggcattattcaaataactattttgatactgagaaaatactaccagtggcatagatacaaattaactcctggatgcttttaactaatttttgtgtttggtgctaatgaaaaagtacctgaagcctttaactttgaagcccgggcttcaaagacatgattgctcagatgtcttgctttattgttgcagtttagcaagacaagaaactctcccaaaatgtcttactattatgtactcactgtagagaaaatatgattgtgaggaagaaaagtaaagaaggaaagcagtgtgagagttaagcacttgaagtttgcctggagtgaagaaggtcctaccagttaagtgctttggattttttcttttttcttttctttctttcttttcttttttttttccagatggagtcctgctcgattgcccaggctggagtgcaatggcgcgagcttggctcactgcaacctccttctcccaggttcaagcaattctcctgcctcaacctcccgagcagctgggattacaagcgcttgccaccacgcccagctaatttttgtacttttagtagagacggggtttcatcaccttcaccaggctggtcttgaactcctgacctcaggtgatctgcccacctcagcctcccaaattgctgagattacaggtgtgagccaccacgcctggctgggattttttcaagaatgtgtactcaaggtccaaacttttagatcatttgaaggaaatccttttgccactctcaggtaaatcactttggagctctgtaaagagtaaaacagccctccgcagccacacacagatttgcatggtggggctgcggagcctcggagtccaagcgtgacttatagtccctcataagcagaggccaagaagaggccagcttttggctttttctttctttctttttcttttttttttttgagacagagtctcactctgtcacccaggctggagtgcaatggtgtgacctcggctcactgcaacctccacctcccaggttcaagcaattctcctgcctcagcctcccaagtagctgggattacaggcgcccaccaccactcctggctaatgtttgtatttttagtagagatggggtttcgccatgttgaccaggctggtcttgaactcttgacctcaggtgatctacctgccttggcctcccaaagtgttgggattacaggcgtgagccacagcgccggaccttgactttctttcttgataactgtaaaagcaactgaaacagatgatgaaagaagaactcactaccatgagccagagcccatagttctcaataactcaccttgcccctgagctgacaccctcccacaccctgcaacaaatacatgtggttttctttctttgagaaacatcactatatttgggcaacatgtcacacacagcccagtgtattctcggtttcccaagtaacctgtagagaaattctatgatgtgatgccctttttcctggaggaccatagaattcagagggagaggaggccttgagaccatcctcaggtctcctgcctgaatgttgctaagcctcaggactccctccacccacatgcaaccacacatagcttttacaaataaattaagagtaagtcttttgcgggtaggtattatggcattttcacctcctctaggcagaagtagtgtggtgcatttttaaggaaggggaggttgctttgcacaggcctggaggcagaagatctagtcatccatatctccccaaagcacactgccccccttatcctcggacttgcttctaagatttgctgtcttgctgagaagttagcagtactcatcctctgaagatgctagactttccagatatttggggaaagccaatgtaatacatagcaccctaggtcagaagtgtgccttgagacagagttctacagtgattacatattttcttcctagtctgagcagccacatatcaactatcaagaaggtttctaccctattcttgatgctatgcctatgcagtttaactccagaatttatgaagacacataatactgttgacagattggatgagaaccattatcatttccccagattatcgacatgtagcatgctattagtaggagacaagcagtagattatgatgtcagtctgtttatgtgtcttctcactaagagaggtgagaaataaaagccagtggggatagaagactggttttggtctggcttaaacctccatactgtggggttttattctacgtagtttgctgtaaacgtgtgcccacttcttccttcttgagggctcccaggtggccatagatctctgtgacatgaagcttctttggagtattctgatgataaaagggagaatttcaattccatttgacaggaagagtcactccctccttgaagtggaaatgaaaatggatccctaactgtgcaagaggcaacgatgaaatagctctccctctgaccctccattaaatgacagcaggcagtagaattattatttggtactttatgcccaccgttgtgtcagctgtacacatgggccaaccacacatttctctccttccataattctgactcatgctgcatgggcttgagaacaatgttgaaaagttcccccagggtttctgatttacagtcccctcccttttccctggtattcaactaatgatttagaagctggaagtagaggaggctcttcttatttctgtcaaagagacagaaaaagagcagtcagagacagactaagaaatcatgattctaggaatggaatgtcccattctagaaggacagtgttcaatgtggtgaagaaattgaggaggagagcagtaggcagaggttattggttttgatggtgatagattctgttaagaaattagtggtaaaatcctggctaacacgatgaaacaccatctccactaaaaatacaaaaaattagttggatgtagtggtgggcgcctgtagtcccagctactgggaagactgaggcaggagaatggcacaaacccgggaggtggggcttgcagtgagccaagatggcgccactgcacccagcctgggcaacagagcaagactccatctcaaaaaaaaaaaaaaaaaagaaagaaagaaattagtggtgaagccatgctgtaaaggggttagaagaatatgggagtagtttgaagatgtggcaaggtcatgtttgtgaacaatggaattcacagagaagaaattttcttgagctgtgatttagtcagattgggatgctagaataccacagactgggtggcttaaacaacaaaatttatttttcacggttctggaggctggaaagtccaaggtcaaggtgccatcatggctcttcctggtttgcaaatggcgtcttcttgtggtgccctcacatgctggacagacaaagagctctggttccttcatcttctaaggatactaatcccatgacctcatccaaactcaattaccttccaaaggtcttacctccaaataacatcacctcggggataacggtttcaacatataaattttggaggagacacaaacattcagtccatagaaagattttttttgaggtttcaattgtataattcttatgaataagttacaagatgtcaactatttattctcagaataatgtttaactgagtaaattgcaaatctataatgatatagtaaaaaccacattgtctgggattttaccacctggaaagtgctagatatcaacacttctgacatttcccaagaaatatttaatttattcctgaggctgatgccaaaagtcaccaactctatgctgaaacacccactacatagcatcacagaatttcagaactgggcaagtatcccatccaaccaactatccttctacagatggagaaacataggcctcatggagaatagaagatgactgttgaagtcctttctaaccctgaagatatataatctcagaaactagcttgctaaagttcatactattcttttaaataagtgaacaccattctctgatcctgattatgtcattactagtgggcaactattgttttttaattcatctgagtgataaatgtgaaatagtacaagcagactatcgccagttctgaatcagctgagtcctaatttatgaggtataaataaatgtattttgagcttctcctgggaatgagagcctatctataatgtttcaatcctgaaaccaggttttatagaagagagactggcattaatcatcacctaaaatccttccaactcatcattgacaggtgtagttagtgatacccatggcttttacacaatgttgtttaaccaggaccaaatagaattctaggaactgattgtccatgacaggaaatcctacctaaacaaaaggcattctaagctcacacagaaaaatgagcaggcctgaacttgagggaacacaagaatgacaacaattgctacatttaaaccaagtgaggggggtaaagagaaactgctgtcagcatttagggagcccaccatcctggttgaagcagacagggcttgattcctgagagatctgcaatgtgcttccttctttagataaatgtggagagaattctgcattcatatgcaactggaattctgaattctgcattcgtattcaactggaattcagagaattctgaattcatattcgactggaaatatggtggttcctaccgcgatgtgcttttctaaaactcccaaatgggtgttcactaagtaaacatgcatttcaaagagaacttaggtaattcccttagcaagagaaaccagaaattctgactggggctccacaatatgtttatgaaaataatctatgtttccggaaattttgggacaccagcggtaaagaaagaaataagactgagaagtccttgaaaatgacaaactaaaaagaagagagatctggaacaataataaaactgcacatagatgagggaaagtttcaagatcttttaagataccagttaactaattgggaatccctgttctgtaattctctagccacacctcccccaataaaacaaattcatttcagcaagactgaaccatcaatttcttatttatgtaagaggatatagaaaattagggtgtcaatattttaaaatttatgcataatttaaaattatacattttttaaaaggctctgggtggttgtaaaaatttaaattccctctcaaaagatctttttggaaattattaaaaagactatgctctgaaaaaaatgtttgtcaacacctggcatgatttcaaagagtgatcctgcacagaaaagtaccaaccagctgatatccacagaaacacttcactgtcaatcattgaggatgaggatccaccataactgtgaggtattcctgttggtcacttatttacaatttcttcaagcaactgtcatactcaggtcaggttgccataacaagaataccatagactgggtggctgacacaacagaaatttatgtctcacagttttgaaggctggaaatccaagatcaaggtgttgccatatctggtgtgtggtgaggggccccttcctagctggccaatgactgcattctcgctgtgtcttcacgtggtggagagcacagggagtgagaacaaggtcttgtgtctcttcttataggggcactaatcccaaccaggagggcttcacactcatgatcaatttacctcccaaagaccctacttcttaatatcatctcattttaacacatgagttttggggaggcacaaatgttcagtccatagcaaggatatttgtcaacttctcccgtaggccaagaccccagttattcttaaactaccactagaaatacacacacacacacacacacacacacacacacacacgtgtgtgtatctatatatacatattgtatatatatgtgtatatatgtgtgtgtgtgtatacactatatatattgtgtatatatacagtgtacatatatacacacacacattgcttttctaagactactgtcttagtccatttgggctgctataacaaagtatctgaaaccggataatttataagcaacaggaacttatttctcatagtcctggatggtgggaagtccgagatcaaggtgccagcagattcagtgtctgttgagggtatgatctctacttcatagatgtcacctctttctgtattctctgacagagtcccccaaacccttttataagaaaattaatgccattcataagggtagggccttcatgatctactcaccacctaaaggccctacttcttaatattatcatattggggatcaagtttcaacataaattttggagggacataaacatttaaaccatagaaatcactgtctcctaacagacacttaggaatactttccaaaaaacttaaaccaacctagattgtgccaaaattaaccagtcaatgaaataaaaatttgaaaaaatttgcaacactgtgcccaaaatgtttttatctaatttaaggggaaacaatacatttccctttggggaattaaattctgtccaaagtgtgagtaaaacatcaagttttaattcagaaggccaatggtaaggagattctttctccaccttctcttttctcacctctcattctcctaccctccttgcaagcacacacaaaggaaaaaaaatgtggtctacattgcctcatagataaggaaccagaggcacagagaactgaaatgcttcactgtatttcatgcagaaagtgtttgctagaattagaattcacttttcactctacaagaccaaacacgacatagactatatagttcctttattgtcattgaagatttaaaatctataacacaatgcaggtagaatgatgtaaattatgtaaagatactcatatagtataaaggtattataatatagtatgtagacactatgaattccaacctcctaaaaacttagctctcctgaaaacctcagagtaaagaaaagtctattgactatgtaatgagactatctctgataattcttatatatagtattctggattggcaagaagtttatttctttttttatttcatcacattcatttagatttatggaagctggaaagatttcccttctcttatggaaatggaattaattgcagcacttcaataatctcagtgaaacccatttcccctggggaaatgaggaaagagacctagacttaatgtagataaaacaaattgacatgggacgtgaatgggagagaaatgagaaaaccattctagactaaaggtcttacacatttcaggaacgagaagtaatagagggatttttattggcagaacttattgaatctcataatttataatgtttaaagctactggtgaccttttcaaaagcaattaattcggttacatatttattgggagctacatcaagctttcaggagtcatgcacgcataccaaggtctttaaaggaacagaattaagtagataaaaggaggaaatcataaaatgtaacatcctttcccaggtggccacagcttgttcttattctatgcttctattagtaaagaccaaggtcacacaagtcagaccacttagagtcctaacaaggaacagacacccttgcaggttctaattgaactgatttgggctagaaactctgtgaacatcactgaagcctgaattttaacaagcaaaaattcaggagggaaaaactattcagatggtcttctacgggaggcaaaatacaaggaaacttttctacgccaacgaactttgcctagcaacgtgataattcacagagtattatcctgcaggcttcaaagacaacagacaatcagcctaaaagttacacctttgcttttaaatttcttcatataactaggaatactggtgtaacaatgtcaattacagcagggggccatacttcacaagcaggaaaattgtagagagatacaggtatgcgccccagttcctgcccctccctttcccacaatggaaagaccacctttcacttcttcgctcactccccatacttccagttaatagcatcaatttcaaatactactacaactttctcatgttccaaaaaattgacaagcacatgaacatccgttcaattttctctggcaaatatttatcaagcagcaaataatgtggcactatactagccgtg

SEQ ID NO: 1939 - DNA, 1115 bp, Homo sapiens
ggaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggagccctgggtggccgtgcgcgggtgggcgcttggcaaggccgccctgctgttggcaccacgtgtttaacccctcagaggctgcagaggggctgggggaggcggcccagggcccagtggtgccccagaggctcccttgtcaccttctcctggtgtccccccacccccaccccacccaggagggcagggccgggtgcccgaggccggtgccagcctgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgcggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggag

SEQ ID NO: 1940 - DNA, 1192 bp, Homo sapiens
aaggtgctagaatccatagttcatcaatgcaaaatgtaaaatgggattcacttccacaaagtcaaacacaagaagtaacagcaaaataaacagaaaaactttatgtaacacattcatccaatgaaataactatctaccatgactggtaatggttgtcctacaagatggacgaaaatttcatgaaataacaccaatacgaaaaatttaaataatagtaatgtttctacttttcaattataaatggctatccacataactgaattttcttctaatctgcttcaagacttaaagaattttctttttctttcctgtactaatcattgaacctcagtttctaataaattttggagcatctgggcctttgaactccttgaataaaggtactgttaaaatactaaggttttcctgtttgttggttggtttgactcaagtagttgcatatatttacaggcttaagaatttgatgaagatcacgtggctgtcactagggagctaagacttgggtccacgtctccccttccaccagactctcacttccaccaatgggagttttactatgaacagatgacagttttccttggagctccccagatggacccaaggtccacgattctatcaatcaatttaggctgtaagaatgttggtccaagagagaaatgctgttcctgtaattgtcttttattcatgaaacattagctctcccactctactgcactactgaaaaataaatgaattaagtggtttttaaagcactgccaaaataggtctttgtgaacctggtgatatagtttggatatgtgtaccctccaaatctcatgttgagatatgatcctcaatggtggaagtggagcctggtgggaagtgtttggagcatgggaggtggatcgttcatgaaggcttggtgccctcacggtggtaatgagggatattgagtttacatgagaactgattgtttaaaatagtgcggcacctctcctgtctctctcttgctcccttttgccatctgatacactggctccccttttgccttccaccaaacttcctggggccctcaacagaagcaaatgccagtatcacgcttgctgtactgcctgccagaacaggttgtaggccaaataaacctcttttcttcagactaacatacctggttatgtatcagctagttacatttatgtcagctctatctctttta

SEQ ID NO: 1941 - DNA, 1600 bp, Homo sapiens
cttgaaatgatacattaatgtctctggaaggcttccagagtttttccagtagttctctttagtggaatctatttatgccattaattaatgtaatgtataaatgtaatccatttaacctcaccaatctcagttgtcttatttgctaaatgggtttaaatacagtgcctaattcataacttaatggtaaaaattatacaagaatatgcatgtaaagcataacaccattgttatataatataaagtaaattttcagtacattttagctgttgttatacatgtgattgtcatctccaatgacaatatatatcattggagggattcagtttgtaaatatttcatttatggttgttgcaactgcattcatgaaaatgactgaagttaatatttatttcttttgtatgtgtactaaaattttgatattaatgttatcctactctcataaaatcaattaggatgggtcctttttttattccctggaagattttgtgtaggatcggtgttacttcttatgtttggaagaaatcactggggtaaagtcaccttggccaggcatttttttttcatgagaatgttttaaaaaacatatttaacctctaaaagaaatgacaagtcatatttcctatcttttcttgtgttcattttggtagtctgtgtttttctaaaaatttggccatcttttaattaaattttcaaattaattggaataaaatttcttagttatttagtaggctaaaaaaatggtctcccaaaagatagtcatgtcttaatcctggaaattatgaatgtgacctcatatgaccaacaacaacaacaacaaaaagttttgcagatgtgactaaattaaggaacttgagaggggggagattattctgggttcttgagtggaccctaaatgtgatctcagatatgcttgtaagagagaggcagacgaagatttcagagacagaaagaaaagacaggaccacaaaggcagagattgaaatgatacagccataagcccgaccatggggtagctatccaaagctggaagataaacgggacgggctttctcgcagaactttgcgaagcagtgtgatctagctgacaccttaattttgacccagtgactctgattttgttcttctggccagaaattcaagaactgtgagagaataaatttctgttgttttaattcatcaaaaggattatgtggtaatccctattaaaacttgtcctggctgggcgccatggctcatgcctgtaatcccagcactttgggaggctgaggtgggcggatcacctgaggtcaggagttggagaccagcctgaccaacatggcaaaaccctatctctactacaaataaaaaaatttagccctcgtggtggcacatgactgtaattctggttactcaggagaatcgcttgaacctgggaggtggaggttacagtgagcctagatagcaccattgcactccagcctgggcaataagagtgagactccgtctcaaaaacaaacagacaaacaaacaaacaaaaaaacttgtcttaatactgtaagaattttcaactgtatttttgtgtttattacagaagttaatagctaagtttttgaaacattaat

SEQ ID NO: 1942 - DNA, 3424 bp, Homo sapiens
acagattagaattggctgctcttaagtaataagtcaccattacccagaaaaaaaaaaactttgaaaagtaaaccagaatattttagcagtaaaattttataggcagtttcaggatgacatttaatactatttgccaaatattctatttcttttttagtacttaaagctctacaactcttcattattatataccagtaactttgattcattcttctttctcaaaaaggaattactatagtttatattgtcttagctgaaatgataaaaatattatctcttaattttaaataaatatccaattttttggaagtattggtaactgaaaaaatcttcctgacaatctggaattcttagaagacattttggtgttttcaggagagcataagaaaatttaaggcagaaatatatattaagttatattttgggaagtttatttggagaactagatgctctatatctgttggatttttgttgttgctgttgttgaaataattttttttaattttcaaatgttacgtatataattttgtccttcttaaattttcattcattcagatgttgtaatactgtattctaccaattttactcctaccttgaaaattaatcctctcatatttgagatgtatgtatgaattattttttctaaaaattctatatttaaactcatttttttactgtgtattctgtatatcatttcaattacgcacttcaacaaatatttgctgatctgatatatattttccaagtcattcttattctatagacagacctacagtgattatctagaatagataatacattatataatattaataatttatagatcattattctatgtagatattatctattcacagataataatctatgctgacagaagtccaaacagtggtcacctttgtggtggctaataggaaggcagcaggagagagactttttacatttctacataaattttatctagaaattggtgttgatttggtaacaatttatcaaattctacccttaacatttgtgtactttatgtaatacatcaatgaatatttacaagttatatgcatataacatatacttacatataacaggtaatacattgtgtacatatatacagtgactatgcataaatataactataagcaaagagagatactcttagaagttatcatacttaactacattgagaccaaaatttgaactttgagagcaatgattcttagtcaacagacatatgctaacttcttccaatatgtctggcctgttgcttggtgctacaggaaacaaaaatgtataagacattgtccctgccttgccaaagacttctaccttattattacgttgtgagctcatttaatacaagttgtgcattattaatttctctatcccagcacctaacagtgtagtgttcaaaaaaggtattcagtaagtatataataaattaactcagtagaaggtgaggagagtgagccaaatgcataaacaaaacatatagatctacacagcacatcattaaccataaaggcacactcgtgagttcctaggaaacagggagaagctatgtttaaaaccttgagacatttgtctacccaatgttagaaaaatacagaccttgctaaaatgaagaaacaggatctactaaaataaaccttacacaggtgggagaaatatcttgcttagatgacaagataagtggagctccctttgtggaagccttcataagggaggttttatcctcttgagctgtttctcagggtttcctgatgggtaaacagccttggactgcctatgggaaactgattcccaaatgtcagacaccagttatgttttctctagtcctcaggaaactgaaaaatatagggagagcatagggcaatttcatattgttaaatgtacttacctaaaataactttttacatatgttactaacctgcacattgtgcacatgtaccctaaaacttaaagtataataataaaaaaagaaaaaaaaaagattatgcaatctttaacatgatattaaaatgccttctctatgccttctctgaaatcatgaaatcaagattctattttcattttattggtctcaattggtcaaaaacaaaatgttgataacaataagtagacctccttcaggtctacttatgagataattatatacatgtatgcacacacagatacattattatgggtgtgtgtgatattgtttggctctatgtccccacccaactcttatctcgaattgtaatcccaataagttaagggaagaacctggtgggaggtgattggatcatgggggcagtttcactcacgctgttttcataatagtgagggaattctcatgggatctgatgatttcaaacgtggcagtttcccctgcactctctttcctttctttctcctgctgccttgtgaagaagttgcctgcttctccctcaacttctgccacgactgtaagtttcctgaggcttcctcaaccatgtggaattgtgagtcaattaaacctcttttctttataaattccactcttgggcagtatctttatagcagtgtataaacggactaataacaatatatataagctggccttttaaaaccaaaatcctagaaatatttacaaaaactaatccaactaaataaggcacttcaatttaagaaaccatacaaaacgtgaactgagctctagcttttcatttatttgtttgtttggtgtttatgccaatgtacctaggaagacaagaatagaatttcctttggaccttgcaggattaggccccaatatgtatttggttccttcccctcaatgttttgttgttgctgctgttttgtctgggtaaatgagcctatgattaagatcaaaggctaactatggggtaacaggtatacaacagtcataaatagtagaaccctgcatacagataaagaaaatatgagtacgacaaagtttgcgtgagtgatgaggaaatgaagacaatgaatgcatatgaactgctggtcaacaggccagtgaggccactagtccattatcttgtatactctaatctcttaatattctatttcttctggagtggtgatatttctctaatttccttagatagactactctaccagtaatacaccttcttctgcaggtttttcacacattttaaatcttccaagttccagagatattttacccaggcatttaaaaaaaacaaagctaagggggtacttgtttttttttaaatgactgatgatatatcctgaatactaatagatggatatgtgaatggctagctaggtaaacagtagatatagatacatagatgtatacatacatacatataaacagactccagcatacaaaaacaacaaaattgcaattaatgttaaattaaatgtacacaaacttatcaatgagtaaagtgaaactcaactaaattcttatataatt

SEQ ID NO: 1943 - DNA, 3350 bp, Homo sapiens
ttgaagtagtctgtgtatgtatttccccaaaaaaagtgaaatcaactaatcataagtgcatatatatacatatatatgtacagatgcctacggtaatttcaacaaatgtttatagaaaaaccataaaagaggcataatttattaagaactaataataaaaaagtaaccccatagtaaattaaactctatgcttaatgttaaagttagtctactttcttttgtttcaggaattggacattgttacagcttttctcaaatacagaaatccttaatggtaatcagtaaaattagtaaaaatgaatgcttgaaattacttgagaaaatagctagcttgagattgtctattattaaatacatttcttaaaataacccattagtagtgaggattagactcatttgctaagttagtgatgaaaaatgattcttctttatttgacaataaagccttaggtattgccctttgggttaagagagataagaactactcaatggaagaagctggatcaatccaaaaattatcaggatgctgtgcctgcaatagtactgctacttactagctctcttaaatctgataaggtcacttagcctcaccaaaatttcagtctcttcccttgaaaaactaatatactactattatttattgtcagaaagaaaatatgaggattagaagtcatgttaagaaaaagcatctggcttacccatggttcttaatgaatgatagctcttattatttgagtctcatcctatcaacaagcaaatcaattatttatctaaatttaaaaacataagaaaaatggaatatacataatataacattaaatatggttaccttaagatataatgattaagaataccaaatacttttctgcagtaactatctgaacagaaagtgatggcctaagattttttatgtgttaactttgaatgtaatggaaaaccttgcaatcccttaacatacagatcataggttcattagcaaactaatgttaccctgtggtacagattgttatatttaaatattaaagtatgttgaaatattctttccatttgatttaatttctaattttcaaaaatctttctttaaagcaaatcattaaattagtcaaagtatgtggaatagtatgaccatatatagccttgacgtatgaggttgtcataagtaatgttatactcaacacagtaacacaactttgtctggaattagaaagaaaaagagaacaaaactaaaattaaaataaatctccacatggatacaataagacataaaggaaggttattcttaatagcattttccaacatctttttgtacttttggctgcaaagtagagtaacaatagacataaaactaaactgcaaatggcttgttattgttcctttgaaatgcaatgtattgtgaacaatatttgtttgggatattttcatttatttggtggaaaatggtcataaaagcaaaggttttttttctttgaggagcataaattgttacattactttaaatacttcttactcaatatagcacaatgctttgtattaaccttttaatattacatgtaaatccagtattttatttgaacatcatttatttgtacaagtaactatttttatataaattttttttcaactcaaggtttttaatgtgtttttttttccctattccaaatttggtagacgtctaaatcatcttttaggaatgtaaaaagctaggcattttaaaaacagaaaattctaggcagtttacctttcaacaatctaaaccaaatcactcagattatccataaaattgtccagaaccaatacaaggaaaaaagcaacattttgacctatgtatcagaaatcaaatcaattatcagacctgtaagtaaaccaaaagaggatccatgcaggcagagataaatcctaaatctcagggtactttgacagtcacatagtaaaagtgattggaaaaggttatcttgaacaaaggttcttttcaagcacataaatcatacaaataattatctctctgaggtgacaggggcctaggaagtgaactactttaggagtagcctccagagatcctcaaccatgtttatgagccgcacagtcatctctataaaagacaagctccagttgagtaaaccatgttaagtactacattccaaagaagaaaaactgtgaatagaaaagttaacataatgcaccattgatatggaataaacacttaatgtctagtttttttatcaataaagtgagtgggatcagtttttcttatttattcactgaagcacattcttataaaagacaaacagcaagcacagcatatttattgcatggtagctctcttatacagtgttgttgatgtttgtttcatttttttgctcatccatgtaacctacacatgttacaaccagcatgctaggtacatgggatataataagattgagtcccttcacaaatcttatacattaaaaaagaattgagaaaaataaatggaaatgaaagttgcttcacattgtgattaatattctagaggggtagtatacttggtttcatcgtggagtgcttcctgcatttaaactcagtccaaggatgagtaggaaattgccaggaaaggtgagtaaggagccaatgttgaaagagaagaatataaatgtggaagttcagggaagagaatgataaattgaagatgcctaataaatccagagtggcacagatgaagaggacaagggcaggtagaagaggtagaaaaccaaggggctataacaaatggcattgtatgctagaataatgagtttgtgcttcagaacaaaggaaagttgttaaaatgttgtaaaaaaaaaaaaaaagactgacactatgaaagttgcatattggaaagaacacactggtggcagtatagaaaacaaatggaaagataggcgggacaggaagaccagaggaaaaacagatgaattaggaggctttcttgtatttgtggtgaactatgataggggctcaaatcaggctgctgtcaacgggaatgaaattatgtgaatgaattggagatatagtttaaagggtagaattagcaggacttaataattaattgttaactctttttgaattggggtatgttcttttgaccattattctttcttctcttagctctgcctatgttctggaggggtcatatttaaatactgactcatctgtaaatttcaagtcagtagttctctttattgcacattttcaaagtggttgttatctactatccacttccttttataattaaaaaaagattatctacatcaaatataaggtaccagaaatagccaattgcaaaccaaaatgggagcagtccagagataggtggctagtaagagctaaactag

SEQ ID NO: 1944 - DNA, 3332 bp, Homo sapiens
tgtcaaaatgccagaccattatcttaatagagagaattttgcaggaatctaaagccttcgaaagctaccatgcatcttggtttgattatggcattataacaagtaagtttttcgtttaaaataattatcttgtttaacagacagtgacatggaatttttacttatattttctacaaatctgttaacaagaaaagtaaactttctggtcctggaggggagaaaataaaacagataataatacttcaaccagtatagtagagcaagggttagggaaaaacacagttgccacagtacaacatatatagaatatgattaattcactaaacaaggaaataaaataaaagcaactgatataaataatttttattctgctctgactgtctggttcagaatcttctcaatcacttatatattagtttatactgcgtaaaaattaaagaagtgtatgtacagaaattttgtagtgatccaataacaagcttatatctgcaaataaatacagttaaatggaaactcaataatatggaccaaaagaataacttcaactagtaaatattaactaacttaacaataagatggtttggtgaagcctaattacatcaattcaagggaagacgataggcatcaagattttattaaaataaaatttaaaagaattactttataggaatacataatataaaaaaaggaataaaaacttaaagattggactacctcaagtgttgagttctacagcatattaatgctcttaaactatatcaatgtatattattatgtgaatgttataaggattaatcacaaaatgttcttgtaaactatccattataagatacattagctcagatcaatatttcttggaaatagaagatatattctaatgtatattaattagaaattactgatgttactagctgagaaatattgaataaaatattttctcggctagagaaatattcctctagctgagaaatattgaataaaagcagaaataaggatgatatttgttatttatatatgatagttataatttcagcagttcacataatttaaaaagagaaaattttattagtttattcatctaataagtaaccatttaagttaccatataaccagatttaattataaaactaatatcacatttgtacaaaatacctaatattatagtggaataacaaacgaaaattgaagaaatagtaagaatgtatgtcatgtctacacagatttcatagtattcatttgcgtaaagaaaaaagtgaactgtgtgtaccctatcaaaaatcttgacaacattctgactttggaaattagaaaaatgcatccataccccacagagcaagcatcacctgttctactgcaggaaaagacaccataaaatataaaacaaaatatctgcaaccaacatgaaacacattgctggtgtgtagaggtctgcccatatactgtaactttagctgtaaatatctatgacagaagaattttcacttttagcatgtgtatatcaattttctctaaaggtggtttcaatttaatcagcacaaaatcaaaaatgagagccagatttcacatgtcagcatgggtgagcaagaaaaatagatgtaaaaagattttgaaaattgttagactaaagatgttcatagagtccatttcaatctcacgatctcacaggatccctgtggtgagtggaaatggcaacagacaggagcaatcacctatttactgatttactagaaaaatatatggtcatcttcagtggtctcagtagttacaataaatgggcaatgttcaattatttttgtattaatgtcatcagaccatagacacaatttcctatagtattttcttaatgtttacttacaaacccatcaaataaatattataatgcccaacgtcttctcaccaacaaatttaaaaaatgccaaaatatctctgataccgggcagacatgcagataagtggaaacttaattattggaaagagtctgaaggtttaatctatgattataaaattaaaataaaaaatattgttctatatgattatgtcattatacccaataatgtcttaggctatggatttaaaatgaatatggtgtgataattggatgaatgttatatatacacataagaaatgccactcaagacacacagatgtgaatatctttgcgagaatatcctcgttttcatcataattcttatgttgagtttcattttattataaacttccatgtattctaagtatgagattttgaaaaatggatgaaaatatatatcctacctactaatatagttggttggctagcaccattcctaatagaaatcagctgcaaacagctttcggcacaccaaagttttccttaggtagaagaaaggttaaactctaagtcataaggtttacaactttttagaaagttgccagaaattcccagtgatttggccaatactcttctgtttagtgaacttagtttactgatgatagggtttctatatcagtatgtttaaattcatgacctattttgataatggtggcatgtatgtataatgatttttctaataaaatggtaacctgctagattacctgctagatttctaataaaatggtaacctgctagaaggaaattgtattttgttccagaatgctacatactgcaaatgtttcaatttttttttaaattttaacaaattaaaatttgttttggatataaattatcaactcatagtaagactttttcatggggaaacttttggaagaaggcgatgatttctcaaaagcttattttatctaatatgttacatgtaagatcttatatgttacatgtgtatacatatcacacatgcacctacatatatggtaagacaaggggtagaacattatagtttactatggtgatgaaccccatggcatttccctgccttgttatctttgcttgtgtttcttctacctttcttgtgactccgacttatctgaaaacaagtgacaaccaacctaaggttctggttcctgtaatgattttggaccaagaatgaagccttcctaaactgggtatttttaagtctctctctctctagaatgtggttatgggctaaattctgcttgtctaggtctctattatttccttagaataatactatgtgaaatttggagttagcctgctatgtaatgctataatctttcactatgtccatggataggcaaagagctgacggtctgtaataaaaaagcatcttaaataagaaagtaaatttcaaagatggtgcaatggaatctcagtaactttcaatgactgcacaagttcatccagctaggaattaaggctaggaagagaaagctggtatttt

SEQ ID NO: 1945 - DNA, 13289 bp, Homo sapiens
aacaatttgtgactggaatgatttaaagccaatacacatgttatgtaatcttctgccctgttataaaatccaacacaattgcttaggactagcgagagacacccagagagcaaaagaaaatctagaaaagtggcaaaatgatccattttaatcccactgaccagcatgagaaaggaaaaaagaaaccagaataatgcatttttaaaaaaattttagaaatctattggagaagaaacctcagaaagactttagaaaaggcgtcaacagcttcagagatacaagactgctgaggctcaaacagtactacggcttgatttcataaggacaagattgaccctacccagaacagccagaatgagaaatggggagtgtggctttatcaggcacacagcaaggtcccgcaagcctgcctggcaggcccctacctactgctttgggtttaaatatcctcaaatcgccctgcaaaatacaaacaggtcgactgcaggaggcacagagacaaactttcacgtgagcttggattggactaacacctcattagcaaagagctgcctcactcagggtaggttcaggagggggaaagagagcctgatgcctgagcaggtgagtgcttccaggtggctcctgggctaagtggaaaaggggagggacaggagggtaaatatggggaaagcctctgaacaaagtacaaagaagggaacagaaggaactaagacagcagttaccctttcacattttgtcagaggatcactctgtgaatataacagtaacaatcttaatttcaaactacatgcaatatagaccatttataaagtttttttttttattgttgttaccctgaatatctctaggatttttctgtggattcccagagtgtttcagctgaattctctagctccccacctcctctgagcacttgctggcatatttccaagctcctctggcatctctcaattcctcaggaagatacctattagccccttcatcttccttttccattttgaataagacagtccaatcttgacaattattaactataactcatcaaatatgttcctctaaaaagacatatttagggaagcactgacaaagacactaacagacaagctgcttcatgctggttcccattaaaatatttaaatatgttttcaggaaagaaaacttttaagttatttttccaaaacagctataacactgatttcaaacctgacaaaaataaccagaaagaaaagtcagatcactctaatttataaataataatgtaaaaatatgaactcaaacatgagcagacagaatccaccagtgcaataatagaataagataccaccaccaaatagagcttattaaagggataccaggatcattcaagaacagaacttttacctctgtcattcataatatcaatacattatagcagaaagatcctataatcatcttcacgggtgctaaaaaagcattcgacaaaatcaaaatccattctgatttaataggcccttaataaaatagaaatccatgaatattttttgatatgggaaagagagatatagatacacatgcatcagctcaaaagcctaaatcatactaaatgataccctaagaggcattcctattaagacaagaatggtcattgccaataccctataattttacactttctaattagtactagtgcaatgaggagaaagtcatgaataataaaaattagaaagagacaaaattattatttttgcagattatacatatatgtacctagaacgccaaagaggatcaactgaaaatggatggatacattaggagagaaggcagatgcttataaagctagtacacataaatagcttatataaacaaaagccaattaaatatacagaagaaaggtatcatttttaagagcaaaatgggcatatatttaaaaaaataaatttagaaaagtatagaattcacaagaaaaaaattttaaatcctacagagagatgtaaaagctggcaaaataatggaaagacagactttgtacttagatggaaagactcattgtaaagatgtattctcccctaaatttaatgtgaatccaataaaaatgtcaataagagtattttgaaacttggaatgttaattctaaattgcacctgagaaattaacctgtgagcattgccagtaaaattctgaaatataaggttattaactctattggctattaagacatacagtaaagctaaggaattagaacagtttgttattagcaaaccaacaatcttctgagggaaaaaatagttcagaaataaacataatgcacatagaaacatttgttatataataaagttgacatttcagatgtgggaaaatggtggattgtctaataaatatgttggtacaactggccagttagtagggagaaaataatgctggttccactctcacttcttacataaaaataaatctcaggtggctcaaatatttaaatgtaaaaaataaagatcttagcggaaacaaaggaacattagaaaaacaataatcttagcataagggaggctctattaggcaaggaacaaaaaccaaatgctatcaatcaaaagagaaagaaaaaaatgataaatttacattgcattcgaaatttctgaaaggcaaagaaaaccacaacaaagtgaaaagcaaatgacaaagaggcaaaagtatctgcaactaatatgttagataaaaggctaatttctcctaaacagaatcccttcaagtctctaaggaaagaacaagaaccttgtgtaaaaatgggtagggttattgtcctctactgggctccctgggaagcagatttaggaggtggagagtcatgtgcaggtttattggggagtattctcaggatcaacacccacagaggaaggaaaggagccaggactgttcagagacgttaggcagtgatgaaatcacaacagagacctcagctgattccacgggcagctcgagctgcgatggccattcagagttgtcccaaactggtaaaaaaggagctgagccttttagtttttggatgtagggtattccgaggaaaggggcgtgacttggccaggggagtgtgttcagcgaaggctgagttccttctgctacccacatgcacagcaactgaggactgagaacttgggtcctacagagggatctgggaagctcagcacagctgccatgactgttagtaggaggcagtccatagaaacagaaaagcaaataatggctagtccatatacaaaaagatgctcactccattcataacaaaatgtaaatcaaaacaagtatcatctctcttatcagataagcaaagataacatggttggcaacagagttgttaatactgatattcttaatgctgttgagtggaatatgaaactctaggatctcttggaggaaaatttggcagatctttctaaatttgaaatacaccctttgacccagcaccacatttctaggaattgtttctatagacagagtcacatgtatatccaaagtatgcactaaagttattaacattggctactttgggggagtatgtctggaagtgaaagaaggataggaaactataagtttcgctgtatatccttttacagtatattgaattttttattctgtatgtgttatttttaaaaatattaatggtcaaaaaggaaatctgaacaggaatttgagatacctatctataaagatatcttgatggtatacgcctctatctaaaagaagcctttttttgtttccatactactatatctaaaatatcttctagattatcttacactcaatgtcataaacttacttctctatacaggatatctgtacaaagattttaaaaatctagatgtatttatcttatgcatagcaaactacaccaattcaactcaaatcctggcagttgttaacacttttggaaagggaactgagctactgatatactactgtgtgcctactatactaataggcactttaatacattatctaatgtaatcccaacaatcctgcaagttacgtcttatcattcccaatttacagatatggacacagaatgcacacaggttaagtatccagtgctctgtcatacaactgaatgtgggggagtccaggctacatctagatgtgtacttccttcgataacatgctcctacctcccagggtattttccttttggcttccaaaacattttgtaagcaaccactggtaacctcaaataagtggtatgatttccattataaagaagaaaagactgagaaagagtaacagagaaatgtctttctctagctcagaaagctacaatttcacatagtcctaaaatgcctgtcttcatctttctgttatctccttttgaatacacttcaatccactcataacccttttcctaaaagagaattcaaaagactgaggtggaatctctgcctcagtcttcctctttgaattgccatcagaaaaacgatcaggggaaatatgttcagccaagagaagggggcagtatcccagcaccatcattttccttttaaacactaaactccaggctatatactggaaacctatcttagggcccattatatgaatcccacagaaagagacccacaaaatttggagacaaaaaagcaatagggagacaaagtgaaggatgcttctctcaaacatcaggacaatttacttaactaatgagttatgagatagcaggtagcttgagtttcccaatatccaacggaattgtttcccaaatgaaaacaaccaatgccaccaaaaattagacttgagccaatggcagaaatcctttttacaatattttaatcgtaagtaatcagaatgcatgatgggttggtttaaaaatatgtcgaggatttttcccctagatagtgttgctgttatccaaaggaaagatgctattgcttctgctccactgacactgtttatcacttcgcccagacccttcaatagaaattgctgtttctcactgccgaccatctgttgtcatctacatgaaaaatctacataaatccctactagttgctgtatttcagaagtgccccccaccaaagaaaatcacagattaattgttgctgctttaaaactctaagaaagggaaatgaatctaaatataccttcctccccccaacacacatacacatacacacacacacacacacacacacgcacacacagcaactttcatctataatttagaaaatggatgcagttcagcaacagttaaagactaatttcttatgctttttgtgcatttacataattgattcactagataatgcactctgcttccttatttaataaacatgttaatgatttcagacaattactcaaagctgcctacaagtgtctgcctaagaaaagcaacaaaaaataattaaaatgaaaatacacaccaaaaggcacatccttcatatcacattacacaagatattaagtcaatatgtcaccctgtcaccagtcacttgctacctgctgttatacatttattcaaattctaatgtattagctgaggctgatacattggttagacacccaagcgggcagacacacagagctagaaaataaacctggtgctttgtcagggtagaggcagtaaaatagcagcagcaaaggaggggagacaataaaacacgggacagaaacagaaggttgaagcagacgctttcacaagaaaaccctcttcaggctattcatggtggggggcagtcacgggggaactaaatggattccatttcctctgccacctctgagtgcttggagagcaccaagcgggccagacatcacaataggttagattttggcagatgcctcatgcattctggccattttcgggcttattttattccccagaacctttgcatgcgtcaaccactagtcatgccttgaaccacacagcaccgtggtcgtttccaccacccaagagaaccgtaaaggtggaaaggggcattaaaggagctcagatgccagacagccacgactttggccctctgtggtgcctggccagtcccactaggcttggctcttccagttcctgctggaagccatgttgcctgggcaccgtgaggctcaccctccctccccagccctccaggaagagagaggtgggtaacccaacaggtgcaataggactctgaagaaggaatatgagagcttccagcccttgctagaagctagctgattctggctggggaagtcctggttccaaacctcatagaagataggttggaagcaggaaaaaaagatgaaattatttgaggagaaagttagctgtccatcagtaacttcttccgctagaaaaggagtgtaggaagaagagtaagtaaacaagaggcttgcttgaccaggtgacactcttcacatttctaagcccaagtgtcctagctggagttaacccatgacttcagtcctaaaagaaaggttgatggtcagtaggcacgtgcgcacacgcgtgtgtgtgtgtgtgtgtgtgtgtgtgtgaaatctttaggtttttttacctgcctccttcactgtataagcccaacctgttcactgtgtatcatgcagaggaaacaggcagaaacttggcagggcaggaacaaggatagttcatccagaattaccttaagaaataggcattttatcaggaaggttatggagagccactaggggacttgaaacaaagggtgacagaaactgttttgcttccagaaggatcattctggcagtaaggtggaaaatggcatgaagggaacaaagagaccaatgaggaggctgtcacatcaatccatcgatgccgaaggcgtgagccaagggactggcagtggaatctgagtgacatcagcggcaacatggggctaaaagaggagccactgaagttttgaggatcaggccacagcagtgatgtggaaggagatgctggtctcagagtggaagggaaacaggaagtgggcaggaggtaggtgggtatcagggtggaagaggaggtatggtccttaacacagctttgtttcagttggatgctggcattcaggtgcctaaggtacatccaaatgaagtattcagaagatggtgccggaattctgcctgtagtttcactctcccacatattaaatggtccactagactacaaaggcagcaaaagggatcttttacccgggttatggcatcaccccgctcaccatcagaaagactctctctagtctctggaaacaacaaggcatgaaacagtagatccactcctatcaagtagcaataaaatacctaatcaataaattaatttaaaccacccctcccttgaaaaataaagaacaacataaatagaatgggaaggaattgcttaatgacattaattgcactcctgcaatttcatggccaattcattcatgttagaaagtggagcagataattctctaaccaaatgtccaatattattatgaaattcttataaatctactcagcagttaatttaaaattagattagaatgggatcatgaagcctgactaggccgaggggaaaggtaacctaggtgaccttttacagaggcaaaaatctacccaggtatgaaagttgattaaccaaagggagtgcacacaccctgcctaaaaagcgtgtggactgcagaagggaggggcagctgcatctacggatagacccatgatgggggctccctctgcagctctgttggggcttcacatcagacaatgtgctcggtcttcttgatgatgccttctacaaatgaacaaaagctacattccaggattccaaatgctgaggtgtggcttacgtaatcaaatgtgagccaggtgttagagacttcatccattcagctgactctgttcctgtgctatctcctacagaaaaggcagcctcctcgccagcttccaccagaaatccaacaatcccagacctattgtgattgttcgtgttactgaaggtctgcagagccatggcgggggagttcccatcagagagtctctttccatgtctctgtgcctagcagctccatctctggtctttcttgtctctcttcatctacagagaaacctcatcttgaaatctggatacccaaggacttcactctatcctacaacgaactcatcagacaagtttctcatcaaaagaaccccaccaccactactagaaaagaagttacttcagcggttaagaagacactattctctctaaatcatttccttcttatttatttatttattgcctttcctatctccctccagaaaggatctgaagaaacttacagcaaaggagtgatgtgccataattcagctatgaggaagggagggagaaaataccctgaccccatgatgattagaactgttgagattccatatgaactccagccaggagctccaggtagccacaacagaacggaaagcactattctggaatagctatttatttcatattgtcataatgataaaacatcctgataccccagaggagaaaacttcagggcagctttcaaagcatcaacttggaaggccaaattattggataagaagtcccattttgtctcattcatagccatgtgacttcagacagttttccattttctttattattgacttaaggaaagaacagatatcggactgggagtcaagaattactggtgtgatgatgaactctgagtccaatggcaaacagcttcacctttccagtgaaacaggaggcaagaaccaaacacagagctttccatctccaatgtcatatggtttttaagataagtatcattggttttcaaagagtactacacatggttaaactcctttctatgtggagagacaggactaacaccccttataaattaactcccaagcttatatagtatcttcaacagcctgtggttctgtgtaacaataagccacacatgacaaggggtgttccaccatatttcttagaagtagaagaaatacacaatcagaaaaccatacgcgaagcatttattggcctccttcagttaatcctctttgggcttataaagctctacatcaattgccattctttaaaatacagtgtacagtttaaaaataagcactgtagagccatcatttgcacacacatgaacattcacaaataatatgtacatacaaacagacagtctcatacatttggtctatatttaatgaccttgttcagccctccctatgctaacactagtatgtataacaatcttaatttaaacccatactcaaaagataacattcctaatgaaacacaatttcaaattggagttaaatctgtctcctagaccaaaatatacaaaaaggctcttgcttatatttttaaacttcatgtgacttatttaaagattcaaggttttcgctgaaatgaggcatagatgactaaactcatttcggctaagtagtaactcaggcagaattctacctgtggatttggattaatactcctcatcaaaacatatggaaagcagtttgaccaggggaaactatacttttctcttgttctgtttaaggcaatggtctgaaaaaaaaatgtgctgggaggaaaattgccatttctctacttatcagtgggcatttgtaatcattacattgtgtcagctgccctttggtgctttcattttttaaattaatttaaatagaactatgcatatctgcagagcttttaaattattagaaggcaaagacttaccttaccaagaaagagaatacaggtattggaacttcatggattacctgacgcaagatagcaagtaagttgcacacatgctgtaattcctacccatcatccagagcagacatcaccaatagatcatgaatagcactcttttactctatgcccaatgtagccttagatttcttttcattgctaccaattgatagtacatgagatgaaagctttttgtattctgtgatgtcatccaagcctgatgttatgagaaagacaccaaacaaactccaagttgggtaagatacacagtagttaggcaatagagccaggcctacaccctgaactctaagctctaaatacagtgctcttccactagacattaagcgcaatgttgtacacttaatatgtaatcctaaataggctgagtgaatagatgaaactttcccctttgttcttcagtaccttctccttttcttttggaaagatatgtctagaacaaagctcctaatcattattaagtcataatttttgggtaccaaatgaagcttactaggcaaataagaaatactgcaactcatccatctgttcaaaatactggagtgtcccattataaatcatctcatgatatcaatctaaatatcctgcatgttaaatcccacaggataagaactgcacacctctgattttgctactattgatctgtgacaccttgaactgaatattcccttctctggccaccattgtctttacctgtaaaacgaaaagtttcaaagatctgacctctaatatactttttgaatacgaagcttatcaagcatgtactttaaattcagcagctatttattaaatgtctcctggaagcagagcactatgacaaatgcaaggcaaagccaatggaaaaaaaacctaaattctggattctgccctccctctagttcctgcattcactattagcacatggtttgtcttgccactcgccaggcccatatcacaaagagggcccactgtgctctagagttgtggaaaatcgttgttcccctttctccatgaagctgtcagtcagagtagtttgggaaaaattccagtgcgatttcattctccgcagctcaatagcttctctatatgcaaactaaaaacaaaaaacaaacaaatacaaattccaccaaatatcctggtggagaatcataaacccggaaaggcagtggcaggaaagcaaatgttataaacacatattttaaatgaacgtttttctgaagtcaacacctaaaactcacattctcttaaagcttccccaactcctaaactggagaaatagttgagttcctgcccagctatcaatgaaaagaagctactagaaggaagtggaataagcaagcagtcccgaggaatatgaaaaaacatgcccattcactgtgaggaaaagagtcattacagatctaatagatgtttccttccaaatcaaacatgtttatgagcaaaagtaatatttatagttaaatatcatatatttatatttaaatgttacataatcatatatattataaaatattatatgtaaatattatattgttaaatatagttcaaatctagaaaaaatattctattgtgtttcacttattcattcaacaaatatgtactaaatccttttgtgtgctaagtaccattctaggtgccggggcatttagtgaacaagagatctttctgcccttatagagctcacatttatataaaaatgaagcctggaaagcaactttttaggacatctctctaagcatccatccatccacagactcaaagatatttattaggtaactacatcatgccaggctttaggttaagctgggagaaaatcaagaacctaagatgcaagcacttgtagataaataagcaactccctacagaataatgcaggtctggacaaagcactgtggacaggctgctactcctttaaatgtagctcactgaagagctactttcatggaggtacggacaaagcattgtggacagaggggtgatcaatgttcttcacattttagaggaagacaagtcacaattgaactggcctttgaagggtgggtaggtgtgtaccaggtcaactaagggggaaaaggtgtcctgattgataatcctatcagaaaaaaagtcacgagagtacacagagggttggacatccacaagaagccctggagcctgcagcactaggtagggattggaaggagaggattccggaaaggcaggttggagccccaaggagctggtctcaatgtcatgtccaggagttcgcccttaacctgcaggaatggcaagatgaacccatttttagtaaatatctggttcaattaaggctacaccatgtatacctaagtggggtgggatggtttatccctcaatgttttgattctcctccaactccaaaaccagtgagggaaattttactaattattactaagaaaggacatgggagtgtgaatggcacaggctggacagagcccaacacattcagagagagagaattttcttcctttcaacagctgcatccagtgagcagctgctaacccactcatagtgccagagagactcagtgggtctgatggctgttaacgggctttattaccttgttgagtacctcaaactccagttactaattacagggcatcgacttgaatgtttggctatataatttttgttaattgatttgcatgaggggatttgggcatgatcagctgtaaatgttcttccggctctaaaactccatgactcttctctattgctacatgcatcaataatgaccttgtgtattttggattgtgggtttcatgcacaattgctaagaacccttcaattgctaagaaccctcaggagcaaagttgttatgcaagggcacacaatgacatggaggcccaggccggaacaggacgcagccattatcattcatgctagctagcatttattgatctcctatcaagaaacagatttggtaaggccaagccacttctagccatttagacaccttgcctgcagtgggctcacacagcttatagacacgaagcaggtggttctgcttgattagtgaatctcaaacccttatatcctgcacttcctagccaaatcctttctatatttctccttcactttccaataccaggtctttaactcaccccttttctcatgcccagttcaccctttaacctccccaaatccacatctcattttgaaggcattcctccccaccaacaacattactctttggggtctttgactgacattctttttcttggcatttcctatttgtgggatgaaaaggggtacaaaagtaaaggccaagataggaaggacccacaggtaggctgattcaatatttacataccagacttccctgagaccatcagcgaactgctggtagaccaagcagttcacactaactctcagagccataagcctttctaatgccctggctttcaaggtgaaaaatacaattactaagaactgtgagccacagcactccattaccaactgagcttccgggcaagagatccttggaaaaatctctgtagtggaaacaagtgattctcagtcacagacaggtcacagatctacgtgacctgtcatccagatgggtcatgagccatttgttgctaagagtagtacaaattttaaagtttcaaaataatta

SEQ ID NO: 1946 - DNA, 716 bp, Homo sapiens
aacaatttgtgactggaatgatttaaagccaatacacatgttatgtaatcttctgccctgttataaaatccaacacaattgcttaggactagcgagagacacccagagagcaaaagaaaatctagaaaagtggcaaaatgatccattttaatcccactgaccagcatgagaaaggaaaaaagaaaccagaataatgcatttttaaaaaaattttagaaatctattggagaagaaacctcagaaagactttagaaaaggcgtcaacagcttcagagatacaagactgctgaggctcaaacagtactacggcttgatttcataaggacaagattgaccctacccagaacagccagaatgagaaatggggagtgtggctttatcaggcacacagcaaggtcccgcaagcctgcctggcaggcccctacctactgctttgggtttaaatatcctcaaatcgccctgcaaaatacaaacaggtcgactgcaggaggcacagagacaaactttcacgtgagcttggattggactaacacctcattagcaaagagctgcctcactcagggtaggttcaggagggggaaagagagcctgatgcctgagcaggtgagtgcttccaggtggctcctgggctaagtggaaaaggggagggacaggagggtaaatatggggaaagcctctgaacaaagtacaaagaagggaacagaaggaactaagac

SEQ ID NO: 1947 - DNA, 1189 bp, Homo sapiens
agaagccaatttacaatgaaacacttcccttagatttgatgaacagtgatatggtgtcagaaccaggaaaattcttatgataattgggtgcattttcctctgcactgttaacatgatggaaaacacagtttaaatattaaatattcctttgtttattatataatgtgatttcagaaatttgtccatttttgtggctgtgattattttccaaagagattaggtgtagttagataattgatttaagtggtatattagcattagaccttggtcctgttttagttaattggtggtattcgtatttttatcataggacagtgtttgtgaaactgaagcttcttgattcttgtatcaggatatggtgagctacttgaggtcaagaaggaagatcttctagcagaatgcctgagtgtgtaatcttgctaagatttagaaagttcctgccctgttcttctttttattaaaattgttttcttctgtacttaatttttctgtttgaatggaaaccttaagttatttaaggaaggctacagtatggaaatcttgagtaattatatacatatatatatatttagagatagggtctcactctgttgcccaggctgaagtgcagtggcacagtcgttgctcattgcagccccaaactcctgagctcaagcgatactcctgcctcagcttttcaagtagctaggactacaggtatactctaccacatgtggctaattattttctgtagagaagaggtcttggtaagttgcctaggctggtctcaaactcctggcctcaagtgatcctcctgccttggccacccaaagtgctgggattttaggtgtgagctacagtgcttggcctgcataattttataacttatatattcaccattttacacattcagagaaaggagttgtaacaagacactttataatatagactaagtcattttattgacagtgtcatgaaagcctcttgagcacttaaatgtggctagtctgaattgagatgtactataaaaatggaagatagtcttgagttatgaaataattttttttgtttgaattcaaaatgcatttttctactgaaattatgttgtgcatggtaggtaggttttctggcctaccctctaaaatctaatgcataaatagagaaattatccttaagaattgatgtatgtttatggggaatgtttttcttt

SEQ ID NO: 1948 - DNA, 2469 bp, Homo sapiens
tagagacaatagatatgcttgtatttccaccaattcccctgtttaagatatcctttgggagccataattaatctgtagcatttaacaagtgttagctttaactacattggaagaaaatttgttatagattacatgcatgggctttggggaaaaatgtttctctttattccaataattttaatatagaacttcattaagcacacaaatcagtgggaacatttgcttataaaaataacataaaccaaactaactttgcattttaaaaatcctcttgttcagttttgtgagctctgcagtcacatttctgatgtatatgctaatggtgtgttttctcacacgttatgtaaaagcaacctattatcttcatttcagattcagattcctgagtcaagcccctattatgacctcagtatggtattttttttactgactcgtttaatcagagcatgaactttgtgaaataatactgttttcccagttttatacataaggaaacaggcttagagtggttcgtgacttgctgaatattatgtagtcagtcagtagaggggctgacccctcgatattttctatttcctgcttttgaatggtgatcaaattagcttggtttgaaaatacgtacccaaaagggaactctattttcctctcaattctgcttttccctcttcccctccacctctctctctctgaaatggcaatgtcattcatttaactttgttttccatttttcacctctacatccaatcaggtccttaaaattcttcctttctttcttttcattactgtggaatcagctatttgctatcctccctgccatttccttgttcagattctcaccctctttctcctgaagaacatcaacagccaacttacttatcatcctgcctacatcctttcttcctcttagtaaaggctcttctgttcttcactaaaagacagatcaaaatgtcttaaacacaaattttattttggtacttccctatttacaatcatcaattggctcccctgtgctcttataacttccaaacattttaatagaatctcaaagctgatattatgcgtcttttttcttgggcctttagcttcattccttgtcactttccacctacaattctctttgacattctttgctctagagataatacatttctttaattcctagatggctgaacattgtcacttgcctttggttctttgaatattttatccctcctccctgaagcacttacaatgtgttctttttaaaaattgtgaaataaaacacacatacacacatacacacatgtgttaaaaagatttaaacacaatgtactatataatgagtaattacaaagtgaacccctgtgtatcctctactgccaagaaataaaatgtcatcaacattccagattcctccaattctcttttatattacattcttcttatcccctttcttccactccaaggacttattcaggctttgtggtgatcatttccttgcttttctttatcatttcaccaattgcacatgcattcccaagcaatacagttcaattcttcctctttttgaaataaataaccacactctgtgttttccttttttcactcataataatgtttgtaatgtttatacatgttttagagtgtatctctagtttcgttttcattattgcattgtattacattgtatgaacatagcctttaaaaaaatccattctcctctcgatgggcattttagctatttcccatttttagctattagaaataatgtcttcaggatcattcttgcatacatgtctcttggatgatgggtatccccataactctagaatatgtatattcaggagtaaaggagagatacatattttcaccttcactagataatctctacagctttctggaatatcactttacacccccacaattagtgtatgaaagttatctttgttctacccgtttccttcacctaatgtttatagacttacattttagccaatccggtggttgttcagtaacatctcattatggcttcaatttgtattcccctgattattgtattgaccattaaaaatctttgtttctgaagtgcctgttcaagtttcttgcccatgtttccattggtttatatgtattttcataatagaagagtttttaaatattttctgcatgctaattccttgtcagttgtatatggtgctcatttggtacctggtctttttactcttcttatgggttaaagcataaactttgatgcaaaattgtctgattcaaataatggctctatctcccttaacaatttgaactttggtaagtcattaaacttctccatgcctcttctgtaaaaatgagaatagtagtagtcctacctcacatggttgttgcttaacctatataaagcagtaaaaagagtgcctgaaacctaggaagtattatgtaaataaacatttgctgttctttatttttattttttgatcatgatttcttaattat

SEQ ID NO: 1949 - DNA, 1322 bp, Homo sapiens
aatatagtcaactttttaaactttagtaacttttagtgttttattaagaacaaaaaggttctaaagttattaagatattctttgtattattttccaagcttactgctttgctttttaagtctacaatccaactggtgttaagtggttgcagcagaagtaaacttttattttttcttatatagataaaccattgtcccacaaccatttatggaaaagtttattttttttccactggtctgcagtgctacctttgccatataatgtacatttatttgtgggtctattttttaattggcctagttactcagtaccaatatcacattctcttaattactgcacatttattattgatatatgttgaagtagttcctgccactttgctctgcttcttcaagagtatcttcataattctttggttctttatttttaactttaagaatttttccatttaactttatgaatcagcatgtcaatttccacaataaaattggaatttcgactacaattttattgagactatagatcaatttgtgaagaattcacattttaagaattatgaaccttccaatctctgaatattgatacatattcctttatttgtgtctttaatgtttctcagtaaacaatatcatgttctcaattacatattcctttatttgtgtcttctttactgtttctcagtaaacaatatgttctcaatagacgtgtttgaaatattactagcacttggtatttttaaatactattgtgagttatagttttttttaatagttttctttcttacttttgtacataagaatccactcaaatttcatatattgattttgtagccagcaagcttattaaattattatactaattttaatgatttatatgcagtttatttttgatcttattaatatcatatctcttgtgaatgacagctttgttttcactgttttcagttcttttatcttttctctctctgtcttgccttattgtggtggttaaaaccacccaaacaacacttgaaatgagaagagttgagttgttacttatttcaataaagtctttattaagtatgatgtttgcagagagttcatagtttacctttatcagcttaatgttgtctccatttctagtttgcttagaattttattatgtatggatgttgaatttcatacaatgattttctgcatctgtggaaataatcatatgatcatatatatttcagttaatatagtaaatcacatttatttattttcttgttttctttttcttaatttttttttgaaactcaagtacacagaattagattaatcataatccttgattcaggaagc

SEQ ID NO: 1950 - DNA, 1652 bp, Homo sapiens
acaacactacaataaatatcactgtgcaaatctcagatgattttcttagcatacattcctaaaaggagaactattgagttaatggtatgagtagtgtgccaactggtactcccataagtgagtgagtgtgggtataatttgtaatattttttaaaagaacagactgcaattttttttttttttgacagggtctcacgctgtcgtccaggctggagagcaatggtgtgatcatggttcaccatagcctcaacctcccagacaagtgatcctcccacttcagcctcctgagtagatggaactacaggcaagtgccaccacacccagctaattttttttgtattttttgggaaaacatgaggtctcgctatgttgcccatggtggtctcaaactcctgggcccaagtgatccacccaccttggcctcccgaagtcctgagaccacagacatgagccaccgcacccagcccagattgcaaatttttagaagtgctatagcgcgtatgaacaaaaactagaatatacaagtaaccaagttttaaaatttcagttaggccaggcacagtggctcacacctgtaatcccagcactttgggaagctgaggtgggtggatcatggtaaaacctagtctctactaaaaaacaaaaaattagccaggcgtggtggcatgcacctgtagtcccagctacttgagaggttgaggcaggggaatcgcttgaacccgggaggcggaggttgcagtgagctgagatcgtgccactgtactccatccagcctggcgacagagcaagacttcgtctttcaaaaaaaaaaaaaaaaggaaaagaaaaaacatcagttaatgtgtagccatattgctttacagtctaaatgaataacttctgggctagcttcaacggacgccatcattctcagattttagccctcaagaatagaggctccctagtttgctttttgtttttgaggcaatagagtctcactctgtcgcccaggctagagtgcagtagcgccatctcagctcaatgcaacctcccacctcctgggttcaagtgattctggtgcctcagcctcccaagtagctgggactacaggcgtgcgccaccacatctggctaattttttgtatttttagtagagatgaggtttcactatgttggccaggctggtctcaaactcctgacctaaaatgatgcatccgcctcagcctcccaaagtgctgggattacaggcgtgagcctctgcacccagcccaaggctccctagtttgattcacaccacataaaatgcctctctgacccacagctaaattcttagtgtcatggtattttccctccagaacacagagtagtaattctgacttaatgacctttctgcaggaacgccactcgtggcagcaacattcctttcctttaaagtggcttttgcttagctgtgaccttagcatttcatcctaacccaggtgaggaatataaagtcattcattataatattctccctcaatcacttgagtccaggaggtcgaggctgcagtgagccatgatcgcaccacggcactacagcctgggcaacagagtgagacccttaatatacatacattctccctctttgtttatgttggaaattttttataataaaaaaaatttaagtacattaag

SEQ ID NO: 1951 - DNA, 4739 bp, Homo sapiens
acactcggaggaaacaaagaattgatttataattacttgatttgctacctttgtccagtaattgattaggttaggggttggcagacttctcctgaaacaggctggagagtaagtattttcagctctgtgggccatatggtctctgtcataactacgcaactgtgccactgcagcgtgaaagcaggcatagacacctcataaacaaatgagtgtggctgtgttccaactaaactttatttttggagagtaacatttgaattttatgtaatttccatgtgttgcaaaatatcattcttctctgaatgtttttcaatcctttacaaatgcaaaaccattcttcacttgagggcctttcaaaaacaaggcagtgggcaagatttggaccacggtttagcagtctcttcctcaggtcacagtttagggttgtagagctgtgatttacttagcaaattctatgtgctgggtactgggctttatcttttcatatataggctcacataatcttcacaaaaactcttaattatgtatttatttgtttatctacaagggggaactggggcttcttgaagttaactcacttgcccaaggttatattttagttatgtaatagtggtggcatgacactttattttttattttatttttttgagacagggttttgctgtgtcacccaggctagactgcattgtgatcatggctcactgcagcctccaactcccaggctcaagcgattctcccacctcagcctcccaagtatctgggactgcaggtgtgcatcaccatgcctggttaatttttctattttttgtagagtcagcgttttgccatattgcctatattagtccgttttcatgctgctgataaggacatacccgagactgggaagaaaaagaggtttaatcagacttaacagttccacatatctggagaggcctcagaatcatggcaggaggcaaaaggcacttcttacatggcagcagcaagagaaaatgaggaagaagctaaagtggaaactcctgatcaacccatcagatgttgtgatatttatttatttatttatttatttattttgggacagagtttcgctctgtcaccgaggctggagtgcagtggcacaaactgagctcactgcaacctctgcctcctgggttcaagcaattctcctgcctcagcctcctgagtagctgggattataggcacctgccaccatgcctggctaatttttgtagttttagtagagatggggtttcaccatgttagccaggctggtcttgaactcctgaccttaggtgatccacctgcttcagcctcccaaagtttgagacttattcactatcacaagaatagcatgggaaagactggcccccatgattcaattatctccccctgggtccgtttcacaacacgtgggaattctgggagatgcaattcaagttgagatttgggtggggatgcagccaaaccggatcattgcccaagttggttttggactcctgagctcaggtgattctcctgcctcggcctcccaaagtgccaggattacaggcatgagtcaccactcctggccgagtgacaatttgaactgaagtctgcctgagtttaattttaactataaaggccctgttcttgtggagtttgcagagttgtggtgaagagagtgggtaataaagcagttttgcaattgttagtagaatattataatttaactaataagtaactctcttagatacaccatattggtaaagcctagaatgaggttggcttttggattgttcatcacttttagtgacagtgcagtggacaggagaggttgtttgggtttgaatctcactccaccccatggaagttcagtgaccttcaagttatttgtcctccctatgcctcactttcctcatgtgtgaagtagaagcagaaagagcgtttgcttaggagcattgttaccaagattatatgagaagggagactgcaggtgatggacatgtagtacattgtcaacagacatgagctcttattgtcactattttttaagagtcaaataaaccccaccggctatatttaagactcacagtgctgctaaatttttttctcccctgctctgtatttccaaaaatatttttggaaaaaagattcagtcttatcaattacattgttcagatcaatgtctttgctttttactaaaccatattactaaattctagtgacctgattttatggtataccaccacaacagagattctatcaagttctctttaccttggtgatatggtttggctgtgtccccatccaaatctcaacttgaattgtagctcccagaatttccacgtgttgtgggagggacccagggggaggtagttgaatcatgggggctggtttttcccatgctgttctcatgatagtgaataagtctcacgagatctgatgggtttatcaggggtttccgcttttgcttcttcatcgtttttctcttgctgctgccatgtaagatgcggcatgtgccttttacctccccacatgattctgaggcttccccagccatgtggaactgtaagtccagttaaacctcattttcttcctagtcttgggtatgtctttatcagcagcatgaaaacagacgaatacagttaattggtactagcagagtggggtgttgctgaaaagatacccaaaaatgtggaagcagctttggaattgggtaacagggagagattggaacagtttggagggctcagaagaagataggaaaatgtgggaaagtttggaacttcctagagacttgttgaatggccttgcccaaaatgctgatagctatatggacaataaggtccaggctgaggtggtctcagatggagatgaggaacttgggaactggagtaaaggtgattcttgttatgttttagctaagagactggcaacattttgcccctgccctcaagatatgtggaactttgaacttgagaaagatgatttacagtatctggcggaagaaatttctaagcagcaaagcattcaagacatgacttgggtactgtgagttttataagggaaacagagcataaaagtttggaaaatttgcagcctatgtgatagaaaagaaaaaacccattttctggggagaaattcaaggcagctgcagaaatttgcataagaagcaaggagcctaatgttaatccccaagaccatggggaaaatgtctccaggccatgtcagagaccttcacagcagcccctcccatcacaggcccagaagcccaggaggaaaaagtggttttgtgggcctggcccagggtccctgtgctgtgtgcagcctggggacctggtgccctgcatcccagccactccagccttggctgaaaggggccaacatacagctcaggctgtggctttggaaggtggaagccccaagccttggcagcttccacatgttgttgaacctgagggtgcacagaagtcaagaattgaggtttgggaacccccacctagattttaaaagatgtatggaaaaacctggatgcccaggcaaaagtttgctgcaggggtggggccctcatggagaacctctgctaaggcagtgcagaagggaaatgtggggttggagcccccacacagagtccctactggggcactgcctagtggagctctgagaagagggccaccgtccaccagactccagaatgatagatccactgacagcttgcaccgtgcacctggaagagccacagacactcaacgctagcttgtgaaagcagccaggagggggggctataccctacaaagccacagggttggagcttcccaagaccatgggaacccacctcttggcatcagtgtgacctggatgtgagacctggagtcaaaggagagagatcatttggagctttaaaattggactgccctgctcgatttcagacttgcatgggccctgtgacccctttgttttggccaatttctcccatttggaacagctctatttacccaatacctgtacccccattgtatctaggaagtaactagcttgcttttgattttataggctcataggaggaagggacttgccttgtctcagatgagactttggactgtggacttttaggttaatgctgaaatgaattaagactttgggggactgttgggaaggcatgattggttttgaaatgtgaggacatgagatttggagggaccaggggcagaatgatatggtttggctgtgtccccaccaaaatctcaacttgagttgtatctcccagaattcccacctgttgtaggaggtacccaggaggaagtaattgaatcatgggggccagtctttcctgtgctattctcatgatagtgaatatctcacgagatcttacggttttatcaggggtttctgcttttgcttcttcctcatttttctcttgctgccaccatgtaagaagtggcttttgccttctgccatgattctgaggcctccccagccatgtggaactgtaagtccaattaaacctcttttgcttcctagtcccagtgtgtctttatcagcagcgtgaaaacagactaatacacttggcaattggtatttatttatatgtttcatagatgtttatggttttataaatacatagtgttctctggtttgcaattttcggtgtgcctttgacattttatgttaactatatatccatttcttaagtgaattttgattcatttactcagtaacccagccgtttttacttttatttctttttagaaatctgtatacat

SEQ ID NO: 1952 - DNA, 1188 bp, Homo sapiens
tgtcaccacttcttaagaagcatagtgcatttacaaaaacactcttccaaggcttatttgcaaatcagtttctcaaagcttcaaggaaatatgattaccaaaaagtaaaagtattatcccgagaaaattgcttatagggaatatcttactagggagtttcgatgtggatctttgttttaataaaacaagcccagacagaaatcagtcagccaaggaaatgagttttgagactggcaacttcagtcaccactggcgtttttttctgcatctgtgaaaattcacaccccacagagatgaggcttcctttatcctacaaaaggaaatgctcttaattccttgacagttccctttccaatctgaaggaagttgttgtttcagcatgaattatcttttcagcaacaaaggtgaaagtgctacttccacttaaaggcaaagcactggcctttgggtcctattttcttgtgagattatttgtgagctggatgcagtgtttgattgttttaaaaggcagccgacttgtccttttggtatttatatgtatagcagaggcaattggaactctgggcattaaattaccgtaatgtgccagttgagaattctattcaagccagccaactccttcctcaaaattatatttttagtgtttagcagctgcaagttcccagaaatcttcaaagtgggatcacttatttcacccagtgcaagagctcttagctgctgccagtgtgagatgatctggtctgggaggcagttgggtacctgggaggggcgagagatcagaggccccctgggttgcccttagttctgcacttatttgcatatgcttccccttggtcaggttactgaacctctgagcctcagttggaaaatggggctaataatatctaccaaatggagctgctttgaggattcaaaataattatgaatcaaccaggcgcagtggctcacagctttaatcccaccattctgagaggccatggtgtaaggatcgcttgaggccaggagtcggagaccagcctgggcaacagagtgggaccttgtttctaccaaaaggaaacaattcgcagggcatggtggtgtgtgcctatagtcccagctatttgagaagctgaagtgggaggattgcttgagccgggagatcgaggctgcagtgagccgagattgcactactgcactccagcttggagt

SEQ ID NO: 1953 - DNA, 751 bp, Homo sapiens
tcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctac

SEQ ID NO: 1954 - DNA, 4009 bp, Homo sapiens
tcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgcttt

SEQ ID NO: 1955 - DNA, 3633 bp, Homo sapiens
tgagtcgtgtaaactatgaaatcaccaaagtcatgtttaataaaactaatacctgggggtaaagcaacttataagacaataggcctatttttgttgtattccttttttcactacatttattttttagagcagttttatgttcacagcaaaattgaagagcaagtacagaggtttcccatataccatctacccctgcacatgcacagcctccccacttatcaacatcctccagaggaatacatttgttacagttgactaacctgaattgacacatcattatcacccagagtccatagtttaccttaggttcactcttcgtggtgtacattgttctggtttggacaaatgtacaatgccatgtatccaccattgtagtatcttacagaatagtctcactgcctaaaaatcctctgtgctctacccattcatccttccctcccttgaaaaccactgatctctttatagtctccacagttttgcctttttcagtattttacaggatgtaaccttttcagattggctttctttaactattaatatgcatctaagtttcctccccatcttttcatcggttgcttccaagttttagcaattatgaatagagctgctataaacatctgtgtacaagtttttgtgtggacataagttttcaattcatttcggtaaataccaaggaactcaattgctgggccgttggtgagagtgtgcttagccttgtaaaaaactaccaaactatcttccaaagtggctttaacattttgcattcccaccagcaataaatgagagttcctgttgctcaatatgtgcattttaattgcaattctgtaaggctctagagagaagtaggcaaagtccaggccctgcagtcaaaaaacttgagttccagacacagctctgccaagggacaactggaagaggaaggtgacggtcggatctccctgcatggtagcgatgaaggataacctagacagtgcgtgcaagtgcattcacagcacctgccgcacacaataaacactaaataaacacaacagtaattattctatgtgcgtgtgcatgctcatttaggaaaaagtagtcagtggctacttttgaaaaaaccaaatatccaatattctggttcttatttttcttctttgagtattttatagctttttagacatttttattttaggttcaggggaacatgtgcaggtatgttatacaggtaaattgtatgtcacaggggcttagtatacagattatttcatcatgcaggtaataagcttagtaacagataagtagtttttctatcctctccctcctctcaccctccagcctcaagtagaccccatgtctcttgttcctttctttgtgtctacgtgtactcaatgtttagctgccacttataagcgagaacatgtggtatttggttttctgttactgcgttagttcactcaggataatggcctccagctccatccatgttgctgcataggacatgatcacattcttttttatggctgtgtagcattccatggtgtatatgtaccacatttcctttattcagtctaccattgatgggcatttaggttaattctatgtttttgctattgtgaatagtactgtgatgaacatacatgtgcatgtgtctttatggtagaaatatttatattcctttgcgtatatacctaataatgggattgctggatcaaatggtagttctgttttaagttgtttgagaaatcgacactgctttccataatggcagaactaatgtacattccaccagcagtgtataagcattcccttttctccgcaatcacaccagcatctgttattttttgactttttaataatatccattctgactgatgtgagatgacatcacattgtggttttgattttcatttgtctaatgatagtgatgttgagcattttttcatatgctcgctggctgcatgtatatcttcttttgaaaagtgtctgttcatgtcctttgccaacatttttttttttttttttttttgagatagagtctcactgttgtcgcctgggctggagtgtaatagcgcgatcttggctcactgcaatctctgcctcccgggttccagcaattctcctgcctcagcctcctgagtagctgagattataggcacctgccaccatgcctggctaatttttatattttttagtagagattttatatttttcaccatgttggcaaggctggtctcgaactcctgacctcagatgatccacccacctcagcctcccaaagtgctgggattacaggcatgagccaccatgcccggccctttgcctactttttaatgggcttgttttttgcttgctagttggtttaagttcctcatagattctggtattagacctttgatggatgcatagtttgcaaaaattttctcacattctgtaggttgtttactctgtttcttttgctgtgcagaagctcattcatattctttttgtagcgggggaaaattacatatatatttaataatcctatattaatataatatgtatatttaaataatcctactgtgtggtatagcagcttaaataaagggtccatacctttccctgctaactgtctctggctctcacataatctttagctcactgattgcatcgctgttttctttgctgtcctcttttccctggtcttgttgcctgtatagtatctctacttggatgtcaaacttgccaagtgcaaagcagaattcttaaattttccacagaagcctgctgctccaagagtctccccatgtcagtgaggaactgaggacccctgttagaatcagtctgagagttttgatgtctttgattccaatctgtctctcacttcacattcaacccatcatcagctccagttaactgtgtcttagaaatgcctcccaatgtaggctgggtgccatggctcatgctggtaatcccaccactttaggaggctgaggtgggtggattacttgaagccaggagttcaagaccaacttgggcaacatggcaaaaccctgtctctactaaataaataaataaataaaattagctgggcgtggtggcgcatgcctgtaatcccagctattcaggaggctgaggcacaagaaccgcttgaacccaggaggcagagattgcagtgagccaagattgtgtcactgaactatagcctgggtgacagagtgagactctgtccttctcccctttcatagcctctgcctttgtgtttttatttagggatggtgcctactttgttttttgctgcatccctaacacccaacaccatatcttgtgtatactgctgaattgaagaaatcacaagggtctgaaagaggacttagagcaaagttggtatggataggaatcttctgctcctcagtgcctcaggggcagtggacacaatctgagggcagccactagggaagcatagatagcaaggagagagagagaagagcttatcacaaggcagtatgatgtggcttcaccagtgtatcaccagccagaacataatttggggaaagggattaaagaacatcttggtctcatctatttgtgatcacttgtacctacagacaaattgaatgtactgatcagccatgtcagccgagtggcttatagaacagaaagtttcctcattctaag

SEQ ID NO: 1956 - DNA, 4902 bp, Homo sapiens
accagatattttaattcacttgtaaatgtaatttcaggttcatcctactagtatgccagataataatgaatcttatacttggagaatatttaagctcagtacagagcaaagtgtttttaaagcaaatattcattgctttctccaactgccatatttatctattgtatttttaatactttttttaatttggagaaaattagagatcggcatgcatttgtaagaaataatacagagagatcattgtatgctttacccagtttccccaaaggtaacatcttgcaaaacttgaggacaataatccaacacaagggtccctcatgttattccttgatagccacactcaattccctccattcttacccccagtttgaaccatggcaataacaaatctgttctctttgcaagaatgttgtatcaatggaatcatgtagcacataaccttttggaattggctgtttttatttttttcattgagcatggttatctggacatcccaccaggacgttgcatggatcggcagtttgctctattattgccaagtagtgcaccatggtatagatgtacccatcagttttttgtcatttacctgttcaaagacacaagggtagtttccagttttttactattatgaataaagctgtcataaacatttatgtatattagtatgaacataaatttttatttctctgggacaccttcctaagagtgctatggctaggttaaatggaagttgcaggtttagttttataggaaattgccaggccagttgaggtggctcacgcctgcaatccccagcactttgggagaccaaggagggtggatcacttgaggtcaggagtttgagaccaggctgcccaatgtggtgaaactccatctctacaaaatacaaaaattagctggtcgtggtggtgggttcctgtaatcctagctacttgggaggctgaggcagtagaactgcttgaacccaggaggcagaggttgcagtgagccgagatagtgccattgccttccagcctgggaggcagagtgagattctgtctcaaaaaaaaaaaaagaaaagaaagaaagaaggaaggaaggaaggaaggaaggaaggagagagaaaggaagaaagaaagagaaagaaagaaagaaagaaagaaagaaagaaagaaagaaagaaagaaagaaagaaaggaaggaaggaaaagaaaagaaaagaaagagaaagaaagaaagaaagagaaagaaagaaagaaagagagagaaagagaaagaaagaaagaaagaaaaagaaagaaagaaagagagaaagaaagagaaagagagggagggggagagagagagagaaagaaaggaaagaaagaaaggaaggaaggaaggaagagaaagaaagaaggaaagaaagaaagaaagaaagaaagaaagaaagaaagaaagaaagaaagaaagaaactgccaaattattgtccagaatagctgtgccattttttattcccgcttataatgtatgactggttaaattttttgcatcctcactggtatttggcattgtcattgttttttaattttagtcattttggtaagtgtttagtgatacctcattgtggttttaattcattttcctagtgaccaataatattgaatttttgtgtgtgatgttaattctttaatttaatttttttttttttttttgagatggagtctcaccctgtcacccgggctagagtgcagtggtgcgatcttggctcactgcaacctctgcttcccgggttcaattgattctcttgcctcagcctccggagtagctgggactataggcgccagccaccacgactggctaatttttgtatttttagtaggaatggggtttcaccatgctgcccaagctggtctcgaactcctgagctcaagtgatttgcccagcttggcctcccaaagtgctgggattacaggcacgagccactttattttattttattttaagttctgggatacatgtgcaggatatgcaggtttgttacataggtaaatgtgttccatggtggtttgttgcacctatcgacctgtcacctaggtattaagcccaacatgcattagctatttttcccagtgctctccctccccctgcaccacccccaacaggccccagtgtgtggtgttcccctccctgtatccatgaatattgaacattttaaaaatgtacttatttgtcatctgtatatcctccttggtgaaaattctcttcatgtttttgcccaagtactaatggtaatgtctattttatttttttaccattgagtaagaaaatttatatattctagatactattcctttgtaaaatatgtggttttaaatattttttcccagactgtgggaaaaacagactttgtctctttaatggggtcttttgcagagcaaaagtttttaatttttatgtcacctaatttgttaatatcctttatgaattatgcttttggtgtcaaatctaagaactttgctctagatctcaaagattttctcccatttttttcctaaaagtttaatcatttcatgttttactgggatccattgtaaattaacttgtatataaaatgtgagatttaggttaaggttcctgcttttgcctataggtgtctgattgttccaagcactatttattgaaaatgctatttttcctctgttggatttcttttatatctttgtcaaaaatcagttggtgatatatgtgtaggtccatttctagattccatattcttttccattatctctgtgtctactcttggccgataccacccagtcttgattactatagatgtataataagtcttgaaattgtgtggactgattcttctcatgttattcttcatcgaaactgttttggctattctagttcctttgcctgtccttataaattttagaacaatcttgtctatgtctacaaacaatcttgctggaacttttacagaaattttgttaaaactgtatgtcaatctggaaataactgccatctttactatgctgactctcccaatccaccaatgtggtatatctttcagtttatttagatctttgatttctttcaccagcatcttgtagttttcagcatatagttttgtacattgtattaggtttacacataactatttcattgatttgagtgactgtaagaggtaataatgttagtctcagctccctggtgttcattacatgtatgtagaaatacaactgagttttttatgttatcatacatcttgcaattttgctgaattggcttactagttctaggagggttgttgttatttgtagattctttgggattttctatgtagacaatcatgtcatctgcaaatagggacaaagttttttgtagatactccttatcaagctgaggaagtacttctttattcttacttttctgaggtattttttaaaatcataaatgaatgtagaattttgtcaaatgctttttatgaataatttgatatgatcatgtgattcttccttcatggcctattaaggtggattacattgattttcaaatattgaaacaaacttgcatctctgacataaaccccatttgttatggtatataatttttatatgtattgcttaattctatttgtgaatattttgttaaagattctttagtctatattcatgagggatgttggcctatagtttttccttttgtgctgtgtctgtctagttttgacattagggtaatactagctttataaaatgaactgggaagggttctcttctatattttggaagagtgtatagagtttatgttaattattcaaaccaagccaataaaaccatttagacctggagatttttgcggggagagtctttaaattatgaattcaatttttcttaaagttataggggtattcaagttatctatttcatatgggtgagttatagtggtttgtgtttttttaagtagtttgtttcatcttagttgtcagatttatatgtacagaattgttcataccattctcttttatggatttgatgtctgtggggtctgtagtcatgtcacctgtttcattctggatactggtaatgtgtgttctctctttttttacccaaacttgataaagattggccaattttattaatcttttcaaaaaacaagcaattggttgctctattttactgttttttaatttcattgatttctgctctaatctttattatttccttccttctacttgctttgaattcatttacctctttctttctaggttctagaggtaggggcatgaattgttaatttgagactcttcttttctaatgtgagtgtttagttctactaattttcctctcagtactgtgttaactatgtgtcataaatttggaaatattgtattttcattttcattcagttttgtatatattttttaatttcttttgaaacttcctctttggtccatgggttacttagcagtgtgttgtttggtgtccatgtgtttggaggtttccctgtctttctgttatagggttctagctgattctattacattcagaggacatactcattagtgttgccaactgccattttttccattgtattttaaaatccatatagtttggccaggtgcggtggctcacacctctaatcccagcattgtaggaagccgaggcaggcagatcacctgaggtcaggagtttgagaccagcctgctcaacatggtgaaacaccatctctactaaaaatacaaaaattagctgggagtgatggtgggtgcctgtaattccagctacttgggaggctgaggcaggagaatcacttgaacccaagaggcaaaggttgcagtgagccgagattgcagctccagcctgggtgacaagagtgaaactccatctcaaaaaataaaataaagtaaaataaaatccatatagtttaatataagc

SEQ ID NO: 1957 - DNA, 14165 bp, Homo sapiens
tgggattctgaccttgatacttctctgttgttcatatatgtgtgaaattagttcctctgaacttttaaaagaaggtttggttcagaatagcttttcttttttcacagagtctccgcttttcagttaacatttaaaaacatggcatccgggcacggtggctcacgcctgtaatcccagcactttgggaggccgaggcaggcagatcacgaggtcaggagatcgagatcatcctggctaacatggtgaaaccccgtctctactaaaaatacaaaaaaaaagctgggtgtggtggcacgcgccggtagtcccagctacttgggaggctgaggcaggagaattgcttgaacccaggaggcagaggttacagtgagccaagattgtgccactgcgctcccgcctgggcgacagagcgagactccttttcaaaaaaacaaaacaaaacaaaaaaacatggcacgccaggtttggtggctttttcctgtaatcccagtcacttggaaggctgaggcaggaggatcatgtgaggtcaagagttctagaccagcctgggcaacatggcaacccatctctgaaacaaaaacaaaaaaatggcacctgtctttctgagatttcttgttctgcttccctccctcattttatttggaccatctctgtttcatatctttagttcctttcttgctcaatgttaatttcaaccccagggttttttgttttgttttgagacagagtctcactctgtcgcccaggctggagtgcagtggcgtgatcttggctccctgcagcctctgcctcccaggttcaagcgattttcctgcctcagcctccccagtagctgggattacaggtgcacaccaccacgcccggctgatttttgtgtttttactggggatggggtttcaccatgttggccaggctagtatcaaactcctgacatcaagtgatctgcccgccttggcctcccaaagtattgggattacaggcctgagccactgcacctggccagttttttttgttttatcacggcttgctcctgtcctgcaagagtcctggctggtccattttcagagttcacagaggctcaactgtgggccccttcacttctgactgtgggctccttgtactcaccttgtattcaatattgggttggagaaaatccctcacagcgttagctgcagttctcaagttgactctgctgtacttgccagtgggtaacctattcgctatatggaaatttttttttgttctcatgtccattacttccttttggcccatccacataaatattgataaatattgataatgctgttgccatacatgtcttaaagcttttggtagtttgttcctaccttcttgaatgttcctagggataccttatcacttgtaaatgttttccatgggtttatggttttgccatttagttgctctgtttttatatggggaaatgaagattaaaaatctatgtggtggctgagcacagtggctcatgcctgtaatcccaacactttgggaggctgaggtgggaggatcgattgaggtcaggagctcaagaccagcctgaacctggaaggtcaaggcttcaatgagcagggtgattgcaccactgcactccagcctgggcaacagagtgagaccctttctcaaaaacaacaataacaacaactatacagctgtcttcccagaatttgcctctggaccagtttaaatgggttggagtttctttttcttttttttttttttttttttgagacagtctccctctgtcacccaggctagagtgcagtggcactatcttgactcactgcaacctccgcctcctgggttcaagtggttcttatgcctcagccttctgagtagcatgttccaccatgtgcagctaatttttgtatttttaatggagacggggtttcaccaccttggccaggatggtctcaaagtcctgacctcaagtgatcttcccgcctcagcctctcaaagtgctatagtcatgagccactgagcctagctgagtttctttttcttttcttttttttttttttttgagatggggtctcgctgtgtcacccaggatagagtgcagttgcacgatctcggcttactgcaacctctgcctcccagattcaagcgattctcctgcctcagcctcccaagtagctgggactacaggcgcatgccaccgcgcccggctaatttttgtatttttagtagagatggggtttcaccatcttggccaggctggtctcaaactcctaacctcgtgatccacccacctcagcctcccaaagtgctgggattacaggcgtgagccactgcgcctggcctgagtttatttttcttaaaggtaatttctctgtcaggttacaaattcttctggagtcatttttgataatttacgtattcctgaaaaattacttcctcctgggcctcaaatttattaaaagtgagcaaagcatttttgtttgatttttgatttcttctatatctgttgttactgttccattttcatttattattttgtgtctgttctcccttatttcttgattcattataggttattctactttctcccccccaaaaccagctcttaacttaccaattctaatttcttgagttgttagatgcttaatttttttctttttattctttcttgaccattcatataaataacagcctttgaattttcttcttagagctactttagctgattaaaattctgacataagttctgatttgtcatttttattgttttctgaatactttgaaattttaggtttgatttactctttaacccaagaattctttgagagagatttaaaatttcccccagcaggtagggattattgttttctagttttattactgacctccagttttttgtggatttattgagattttcttggctacctaatataagattacaatttttaatgttctgcgggagttttaaaagaagatgtattttctgttttataataagattcccacatatcgactaggtatttttaataaagttttttcctttttttttttggtgtggcagtccatttactctgtgtagaactgagaaaagttcccagtaatgtatttcagtttcatctcatattttctgtgtttttgcttctgaatgtcaggatgtttgaatagtatttattagtactaaatctgcattatgaactacagtttttatcatcacgaagtacacttcttgtctggtattatcacgaatgcagctttcttattatatttgtttggtattgtttctaatcttattatttatatttgtttggtattcctttgtctactcttttattttcaatccttctgaatcattttattttattttattttatttatttatttttgagacggagtctcgctctgtaccccaggctggagtgcagtggctcgatctcggctcaccttatgctccgcctcccgggctcacaccattctcctgcctcagccgccggagtagctgggactacaggtgcccgccaccatgcccggcgaattttttgtatttttagtggagatggggtttcaccatgttagccaggatggtctcgatctcctgacctcgtgatccacccgcctcggcctcccatagtgctgggattacaggcgtgagccaccgtgcccggcctctgaatcattttatattagttacatcttttttttttttttttttttttttttttgagacggagtctcgctctattgcccaggctggagtgcagtggcgcgatctcggctcactgcaaactccacctcccgggttcaagcgattctcctgcctcagcctcccgagtagctgggactacaggcacctgccactgcgcccggctaattttttgtatttttagtagagacgaggtttcaccgtgtcagccaggatggtcttgatctcctgacctcgtgatccaccagcctcggcctcccaaagtgctgggattacaggcatgagccaccgcgcccggccagttacatctttttaaaacattttagccaggtgcagtggcttacagctataatctcaacattttgggagaccaaggcaggaggatcacttgagcccaagagttcgaagccagcttgggcaacataaggagaccccatttctagaaaaaaaatacaaaaagttagccaggcatggtgatgcgagcctgtaatcccagcttctcaggagactgaggcgagaggatcgcttttgcccaggagatggaggctgcagtgagccaagatcgtgccattgtactccagcctgagtgacagacctcatctcaaaaaaaaaaaaaaaaaaaatacacacacacaaaacattttagttaaattaaaatgtaacttaattttaattcagatatcagaaaattttttcttagatttttttgtttgtttgttttttgtttttgagacagagtctcgctctgtcgcccagactggagtgtaatggagtgatctcagttcactgcacctctgcctcccaggttcaagcgattctcctgcctcagcctcctgagtagctgggattacaggcacatgccaccacgcctggctaatttttgtattttagtagagacggggtttcaccatgttgttcaggctggcctcaaactcctgaccttgtgatccacccacctcggcctcccagagtgctgggattacaggcgtgagccaccacgctcggcctagatttttttatgtagcatgtatttggattttttttgttatttattctggaggttgtactttaataggtgagtttagctcatttttaaaaaaattgatctatgtttggttttagtgctgtcatcaaaagatctgctagagtttgtttatgtggccttttttttgcctttacatgatccattatggtttcacttttgtttgtatcctctgataattttcaaagctttgtgtttttaccttgtggattggcttttaactgtaacataaaatgtatacttattttgtctgtcaacttttcatttaagattttaatcctatagaaaaggagaaagaattgtacgatgaacatatatgtttcgttcaactggatttaccagttgttttcactgttctttaaaattcattgctttttttttttttagaaaccagtctcgctctgtcacccaggctggaatgcagtggtgctatcatagctcactgcagcctccaactcctggactcaagtgatctttcagcaccaactcccaagtagctaggactacagatgtgcgccaccatgtccagctaatttatttatttttatttttatttttatttttatttttgaaatggagtctcactctgtctcccaggctggagtgcagtggcgtgatcttggctcactgcaacctctgcctagcagatttaaatgattctcctgcctcagctgactcccaagtcactggtcgtacaccaccatgcctggctaatgtttttgcatttttagtagagacagggtttcaccatgttggccaggctggtctcaaactcctgaccccaagtgatccgcccaccttggccacccaaagtgctgggattacgggcatgagccagctcacgtggccagcagcaaacttatttttatgtttgtagagacgggttcttgctgtgttgcccaggctaagctcaagtgatccttccgcctcagcttcccaaagcactgggattataggcatgagccaccccacccagccctcaccagttgttaatattttgctacatttgctttatttctacctctatctacatgtgtattttggacagggaatatttgaaaataactcgtaaaaatcatgattctttgtctctaactattttagcctgtattgcttgaaaacaaggacattctcttagccacaacgccagtgtcacatcctagtgcttcaacattgatataatatctaatatggaatccattttcccagttgtctcaataatgtccattatagcatttttttgtgtgtgtgatccagtcgaggatcatgcattgcatttagtcatatctcttcttttgttttctttagtctacatcagtctccccatcttattttatttttatgaaaaatccaggtcttgtaaaatgtctcaacatttggatttatctgtttcctcatgactaaatgcagttagattttctggtaagaatacatcatacaaccttttcattccatcagtcaagaggcacataatatcagattgtctcattatttgtcatgctaagtttgatcacatggttaagcttgtatatatgtatacacacacacacacacacacacacacacacacacacttttttttgtttgtttttggagacggagtcttgctctgtcaccctggctggagtgcagtagtgcaatctcagctcactgcaacctctgcctcctaggttcaagtggttctcctatctcagcctcctaagtagctggcattacaggtgcctgccaccatgcccagctaatttttgtatttttagtaaaggcagggtttcaacttgttggccaggctggtctcaaactcctgacctgtgctctgcccacttcggcctcctaaagtgctgagatgacaggcctgagccaccatgcccggccagtattttttatgatatcttttgacttcttcctatgagcaatgacaaatatatttctttttttttttttttttgagatggagtttcactcttgttgcccaggctggagtgcggtggcacaatcttgactcattgcagtctctgcctcctgggttcaagcaattttcctgcctcagcctcctgagtagctgggattacaggtacccgccaccatgcccagctaattttttgtatttttcgtagagacaggatttcaccatgttggccaggctggtctcaaactcctgacctcaggtgatctgcctgccttggcctcccaaagcgttggtattacaggcgtgagccactgcgcccagccgacaaattctttttcctttccctcccctcccctcccctcccctcccctcccctcccctcccctccccccctcccctcccctcccctccccctcccctccccctcccctccctctttcctccccctcccctccctctttcctccccctcccctccctctttcctccccctccccctccccctccccctccccctccccctcccctcccgttcctttcctttttttttttttgaggcagagtttcactcttgttgcccaggctggggtgcagtggcatgatcttggctggccccaacctccaccccccgggttcaagcagttctcctgcgtcagcctcccgagtagctgggattatagacatgtgccaccacacctgggtaattttgtgttttcagtagagacagggtttctccatgttggtcaggctggtcttgaacttccgacctcaggtgatctgccgacctcaggtgatccgccaacctcaggtgatccgcctgcctcagcctcccaaagtgctaggattacaggcctgagccaccgtgcctagctgacaaatatatttctatttccatcctttttatttttcttaatacttaaaaaaatgtacttatacctctgttatttgatttagtgattttatcttttggtcttactatggaagatgaggaagatgagaaaatctacatacttatgctgctcccacctttctccctcttctcttccaacatttcttattcgttcattcacttttttaaatgaagaaaaggaaacttaaactgtatccagtaattataaaaatgacccaaaacatccttcaggtctatattttcagtttcatgggtgaaacctacccatggaacttggtgagtttagagtaattggaagagactggctgagagaacagggaaaaaccagggcgtgggaagcagtgcctgtcggcagcctttgggtttgggtttggactgttatttggactgttacacttgtcatctacctcactttaaatgttggtttatgatttttcatggctatccttggtttgacttttctaatcttaaaattttagacagtaatatgaagggtagcattgttttctgagctgcaataacaagtgccagggaattcatttgggaccagtatcaagctgagggccacacctgaacctcagtttttaccagctccttcccttcccttcatggccttccatttttgtgtctagatgtgccttttattcttctcttcaggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaagaaaacgttctgaattgtttgcctcatgttttcgcccttcctttctgtacttatatcttgcttacctaggtaaccatccgctcctcaagataacctattccaaagaaattccaaatcacagagagtggtgaactgctggtctgctgcccctctcgtggtaataatcaaagagctaacatttttttgacactataggttgatttttcaatattttagtgacatttagctattatatagaattatttgttgatgtaagcatttgcattcttcacagcttagaggatattcttatttctcctcttttaatctttgggcaagtgttctg

SEQ ID NO: 1958 - DNA, 87096 bp, Homo sapiens
gagtccgtttagcgatcattcagagttgagaacctcataatcgaaaaatggtatattgagcactaaagtcaacacatcctagtaaacagaatgtttctgtctttattttgtgctgctgtaacagaacaccctgggactgcataatttataatgaacagaaattcattggcttatggtttaggaggctggaaagtcaaaacttatattgaattctttcagcacctgggagcagctaagtagaacaggctttagaattagacttaattttgaaaccaggtgctagcactgaccagctaatggtgagcataagatgccaatgttatctctcagagtctctgtgacctttgttgtaaaacagaaattagattttataacagcaccaatcctacccatacgatggagcactcctggcctaatcacctctcaaaggcccacctcttaatactgttacaatgtcagttatatttcaacatgagttttggtgaggacaaatattcaaaccatagcagtttctaactaaagatatctactttaactcaaggtatttattttaagatgatatatcttaagatttaagattatatctagtggcagagtagcattcactggatcgggataaaagaacaattctgaaatcctctctttccatgattttcccaatcccatactttgactgagacctacaaattaaaagaaatatattttatatcaacactatgagtacacacacatacaccccccacagactcctgaaacaaaattttaaaattatatggtatgatttctattgctgcatactaagccagcccaaaacttggttgcttgaaaacgaaacaaaaattgctcacaaatgtgggattcaggcaggacttataggtggtagggatagtatatctgatctctcctaccccacttggcattagctgaggcagctcagcagggactggaggatccatcctcaagatagctgatctacattgctggcagtttaatgttggctatcatttggtagctaagccagggctgtgggtcaaggtcctctccatggacttcttggtttcaaaagcaaaccttctaagaagagaaggtggaagtatgggcattttttatgatccaacctaagagaacacttcgtgtcacttttgccattgttatggactgaatgtttatgtctctccaaaatttgtatgtggaaatcctaacccttaatgtgatggtcttaggaggcagggccttagggaggtgattaggtcatgagagtaaaaccctcatgaatggtactagtgctcttataaaagggatcccagagagctttctcactctcttcctgccatataaagatataagaagacagtggtctgaaacctggccttgggtttcagaacccaaccatactggcaccctgatctcagacttccaacctccagaattgtgagaaatgcatttctgttgtttataagctacccaatctatggtactttattacagcagcccatgtcagccatattctattggttgaagtagtcacaaaggtccacccaagttttcagggaagagacaaagaccccccactcaataggtagagcatcaacatcacattgcaagaagaatacattgaatgggagaaactatcttgggtattcatagaaaatataatttgccacactctgcttaccttgtaccatactacactataccacactggtactatactacgggacaagcagtatattctgatatattgtagtctactgttttttatgctgatgattaccactgaactgtgttaacaatctagtggctccccatcctcagtttgaaaaacactgtcctgtacaattgtaaattgagacaatagtaaaaaatttcccttctacactggcagaatgctttaagaaaataaatacagggattactgaaatagatcagaaagattaaagtaaaaataactgagcaaaatgaagtttgccacttttactttctaatacctgtttataagagcaatgtttggcaatctcagatgagttcattttataactgagtcaaaatcttaacatacatcattgcttaggccaaaataaaacctctaattattatggcaaaccatgatacctctatacttttttttatatataaaatgcctttttcaagtcaattgtagaaaatgtgcataaccaactgattgtaacacaatcctttaacttgattcattctttacttattcatacaaactatttaggtatggaatttaagagttccttgaagtcatcatctttgtgacaagatctctaagcaagcaagtggctggcgccgtaaaggctaaaggaagagtgatctaaatcttgttcctctgaatgggtcctggggaccaatagtctgggtatcacctgagagcttgtagaaaagctcctgacaagtcagaatctgcattttaacaagataccccaggagattcctgaacccattcaggtttgaatagtactgaccgaaatcgatgttttccgaagtgtttagtttgtgcaacctatgagtaaaatatgtggcatgagtatatgtctatgtgtatctttgcataatacacatacactgctataatattttataaaccatatgatgcatcaaatagaaatttttaacagatgaggtaaacagatatcagtaggagttctaatccttctctctcactccctcactgtttcatcttaataagttccagaggtacaagcaccctgttttggagcccactggcctaaatcacaccacgagctcaaatagctttctcttgactaagtcacattgcccagaaacacatgaatactcttgtgacacgctgcagtaaaatgaacaatttataaagttccatgcatttaaaattccttcccctctttaaaagcaaatatgtgttgatatacttaacagatcattaaattttggcttcttagaaattaatcgcttattttaaggaactctgatccccagtattgcttgcaggaaatgagtaaacatatgtttgcatgtgagatgatacactggcataaacttttaatagcacactttaaaaatgatgcaaggtttctaaaaattataatctagccattaaaaattatacagtaggccaggcgctgtggctcacgcctgtaatccctgcactttgggaggcaggtggatcacctgaggtcaggagttcaagaccagcctgccaacatgaagaaaccctgtctctactaaaaatacaaaaaattagccaggcatggtggcaggcacctgtaatcccagctattcaggaggctgaggcaggagaatcacttgaacccgggaggcggaggttgcagtgagccgagatcatgccactgcacttcagcatgggcaacaagagtgaaactccatctcaaaaaatatatatatataaatatatatataaatatgtataaatataaatatatataaatatatatatagagagagagagcacctgtgtatatttttttgacacagaaaatacggtatatttttaagtgaaatctaaatgctagtggtaaccacagattattggggactgtgtttcaatggttctcattatgtttttgttttatttgtgttttctaattcttctgcaattaccatgttttatttgtgtaatgaattagtcactaacggtgacatcactggcatgccctgagcctggggtgcctaatgggttgaatcaattcttcacgtagttactggagtctgccagtcagttttcttttcttttttaattgtttttaattttttgtgggtacagatatttatggggtacatgagatgttgtgatacaggcatgcaatgtgaaataagcacatcatggagaatgggatatccatcccctcgagtatttatcctttgagttacaaacaatccaattacatttttaaaagtatttgaaaatgtacaactaagttattattgactatagtcaccctcttgtgctatcaaatattaggtcttattcatactttctaatttttttgtacccattaacaatccccatctctcgctcacattccatccccaactacccttcccagcccctgataaccatccttctatgctctgtctgtgagttcaattgttttgatttttagatcccacaaataagtgagaacatgtgatgtctgtctttctgtgcctggcttatttcacttaacataacgatctccagttccatctaagttgttgcaaattactgcatctcattcttttatggctgaatagtattcccttgtgtatatgtaccacattttcattatccattcatctgttgaaacttagattgatggccacttaggttgcttctaaatattagttattgtaaacagtgctgcaacaaacaggggtgcagatatctctttatatactgatttactttcttttgggtatgtacccagcagtgggattgctagatcgtatggtagctcaatttgtagttcattgaggaacctccaaaccattgtccatagtcgttgcactaatttacattcccaccaacagtgtatgcaggttcccttttctcaacatccacaccagcatttcttatcgcctgtcttttttatacaagccattttaactggggtgagatagtatctcattgtaattttgatttgcatttctctgatgatcagcgatgttaagcacctcttcatatgcctatttgccatttgtatgtcttcttttgagaaatgtctattcaaatcttttgcccgtttttgatcagattattagattttttcctatagagttgtttgaggtccttatatattctgattatgaatcccttgtcaaatgggtagtttgcaaatattttctcccattctgtgggttgtgtcttcactttgttcgttgtttcctttgctgtgcagagcattttaacttgatgtgatccaatttgtccatttttgtgttggttgcctgtgcttaggagtattgctcaaaacatttttgtccagaccaatgtgctgaaaattttccccaacgttttcctgtagtagtttcatagtttgaggtcttagatttaagtccttaatccattttgattgatttttgtatatggcaagagataaggatttagtttcactcttctgtatatggatatccagtcttcccaggaccatttattgaagggactgtcttttccccagtgtatgttcttggcacctttgtcaaaaatgagttcactgtaggtgtgtggatttgtttctgggttcttgattctgatccattggtctatctgtttgtttttatgccagtgtcatgttttggttactatggctctgtagtataacttgaagacagggaatatgatttctccagttttgttctttttgcttaggatagctctcgctattctgggtcttttgtggttccatataaatttttaggatttttttttttctgcttctgtgaagaatgtcattggtatttcgatacagattacattgaatctgtagattgctttgggtagtatggacattttaataatattcttccaatccacaaatatggaatatctttcctttttatatgtactcttcaatttctttcaccaatgttttatagttttcatttgagagatctttcacttctttggttaagctaatccctaggtatttacttgtttttgtagttattgtaaacaatattactttttgatttctttctcagattgttcactgttggcgtatgaaaatgctactaatttttgtatgctgattttgtatcctgctgcaactttactgaatttatcagttctgatagtttccttgtggagtccttaggtttttctaaatataacatcacaacatctgcaaacaaggataatttgacttcttacattccaatttggatgccctttatatctttctcttatttaatggctctagctaggacttccagtacttttttgagtaagtggtgaaagtgggcacccttgttgtattccagttcttagaagaaaggctttcacttttcgccattcaatatgatactagctgtgggtctgtcatatatggcttttattatgttgaggtataatccttctacccccagtatttttagggattttcatcattaagtgatgttgaatttcatcaaatgctttttcagtatcaattgacatgatcatatggtttttatccttcattctgttgatgtgatgtatcacattggttgatttgcatatgttgaaccatccttgcatcccagggataaatgccatgtgatcatgatgaatgatctttctaaggtattgttgaattcagtttgctagtattttgttgaggatttttgcctcaatatttatcagggatattggcttgtagttttctttttattgatgtgtctttggttttggtatcaaggtaatactggcctcataggatgagtttggaagtattcccttctgtattttttggaatagcttgagtagcgttggtattagttcttctttaaacatttggtagaattacagtagtgaagccatcaggtccctggcttttctttgctgggagactttttattacaactttgatctcgttacttgttattgttctgttcaggttttggatttcttcatggttcactcttggtagattgtatatatttgtctaggaatttatctgtttcctccaaattttccaattgattgacatatagttgctcatagtagccactattgaacctttgaatttttacagtatcagttgtaacatttatttttttttcatttttttattttttgagacggagtctcactctgttgcccaggctggagtgcaatggcctgatctcggctcactgcaagctctgcatcctggcttcccgccattctcctgcttcagcctcccgagtagctgggactacaggcacccaccaccatgcctggctaaatttttgtatttttagtagagacaggatttcagcatattagccaggatggtctcaatctcctgacctcgcaatccgcccgcctcagcctcccaaagtgctgggattacaggcgtgagccactgcgcccagcccttttttctcttttattttatttatttgggtattctcttttttatagttagtctggctaaaggtttgcaaattttgtttaacttttcaaaaacccaactttttgttttattgatattttgtatttttttatttcaatttcatttttttctcctctgatcttcattatttattttcttctactaattttggatttggtttgctcttgcttttctagctttttaagatgtatcattagattatttatttgaagtttctccattttttgctgcagggacttacagctataaacgtccctcttagtattgcttttgctggatcccataggtttttgtctcttgtggtctaggtgccacctcagccacagtgcagtagaacaccaggtagacatctaaggcttttgattctagtccttaactcccagatggcacctttgaacccacccagggcctgggagacctcactgcccttccattatcatttgtttcaagaaatttttcaatattcttctgaatcacttcattgacccactagtcattcaggagcatattgtttaatttccatgtatctgtatagtttccaaaattgctcttgttattcatttctatagttttattctattgtggtcacagaaggcttgatattatttctatttttttaaatgttttaagactcgtttcatgacctaacgtatggtctatccttaagaatgatccatgtgctggtgaaaataatgtgtattctgaagctgttggatgaaatgttctgtaaatatctgttagatccatttggtctagagtgcagaataagtctgatatttctttattgattttctgtctaaaagatctgtccaatgctgaaagcgggatgttgaagtctccagctattattgtattgggacctattcttctctttagcgctaataatatttgttttgtagatctggataccccagtgttaggtgcatatatatttaaaattgttatatcctgttatcaaattgacccctttatctttatgtagtgaccttctttgtctcttcttatagtttttgtcttaaactctgttttgtttgtatgagtatagtgactcctgcttttcttggattccattggtatctcatcccaagattccattgggtctcacccaaggcctatggccttggctcctgcatatgttcactcaaggccctggagctctacaatcagctggtggcaaagccagtcaggccagtgtccttttgttcagggcagcaaggtctttcaggccctgggtgggttcaaaggtgccatctggaagttaaggactagggtcaaaagccttagatatctacctggtgttctattgtactgtggctgaggtggcacctagaccacaagatatggttcttcccactcttccctcacctttccaaaggcagaggagcctcaccccatagccaccaccatctcagaccacaaagaatactgccagactaccgcccatgtttccttaagacccaagggctcttaagtcagcttgtggtgaatgctacctgtcctggaactcatccttcgggaaagtggactctggtatggccccgcacaggatcagaaatgccatctaacagtcaattcctggaatctgggaccccaagagcttcctgagtactctaccctctatggccatgctagtacctgaagcgagcaaatctcagaggctcacccaaggccctcaacatagtatctgggtatcactactgatcattcaggggccaggggctcttcagttagcaggtgatgaatgctgccaagactgggtgggtcctttccttcaagtcagcagtttcccttctgacctgggatgtctctagaaatgtcatctgggagcaaggacctggaacaggggcctcaggactctgacagctgccctatcatactgtggctgagctggtatccaaaatccaagactaagtcctttcaacccttctctctcctctcctcaagcagaaggaaagggtctgttttggagccaggagccatgcagcctgtagttaggggaagggtgatgccagcactcccttagtcaccccagcggatgtctcagtatgtcaggtgccccccaagtcctccatctctaattcaccattaggacttgcctaagagtttcagtccttatggcctagcctgcctttcaagtttactgggagacacagagcactttggccctcagtggcaaggtttatgagaactcaagttctgaccacaggggtcagtaattcccctctggctagggctggtttaaatgctccctctgtgggtaaaaactatcagctgagtttggtcctgttttcctttctgccctaacaaaatgcactgagttcagtgactcacagttgttgtgttctccttccccagatgcccagagatgctctctgcaccacgctgccattgctatggggagtgagagaagggtggtgttggtgattcaggacttttttttttttcctgtttcttcattgcctctttcagcaatggaagttaaaaccaggtactatgagggcacactgatttttggttcttatggtgttttttctgtgtaaatagttgttaaattggtgtccctgtagggagggatgactgttggagcctcctattctgccatcttgctccacctccagtttgccagtcagttttcatataaaccagagggaaggttatacgctgtctgttttttcctctgtaagtaatcagaaattacaccatctgtatgttatatacacatgtacataacattcctgtcttagtttgttcagtcggctatagcaagttaccatagactaggtggcttagaccacaaatattcatttctcacagttctggaggctgaaatccaagatcagggtgcgggccatcttcccagttatgtcctcacatggccttccttggtggtgcatacaagcagagagagcagaaatgatcttgtgtctcttcttctttctataagggcattaatccatcatgggaacttcactgtcatgacctaatcctctccagggcttcagctcctaataccattacactggggttagggcttcatcatatgaattggagagatacaaatctgtccatagcatttctttcacagctaaattggcatttacatttcaagaagagaaagtgtccaagagtaacaattgaagtataaagtgggttctttcttttaaacactttgtattatgttatctccatcatgaagccgtttaagaaaaggaactgcattctcagtgtattagttatctattgctgtataatctgtataagttaccccaaaactcagtgatttaaaacaatagtaaatatgtatcagcattgatagtttgtatggatcaggaatttgggagtgccctggttgggccttagtggcttggggactctcacaaggttgcagtcagattagactgtggccttagtcatggaggcttgattggggctgaggatatacttccaaggtgactcaagttggatactccccaccagggcctcaccacagggctcctcatgcatctccacagcatggcagctggcttcccccagggggagcaacgggagagacccttaacagaacctgcaatgcctttcctaacctgccttgagaatatcactccatctctctgccatattctattcgtctcaccacaaccctgattcactatgggaaggggattatacagggatctgatactagaggacaggaattattggggcccacttggggtacttaataaccaagagtggttattaggtgataatttcttatgtgatagtttcttatggtgtactgcttagtaaagacagtgcttttaaaatgaagtgtaggttaaatagacaccctcatcccaagtgcctctaaagcaaataactgaggtgatgttgagaaaggccaaagcggtaatcacttacggagagttcaagaagtgtaatgcgcacagtgggttctgggaggaccctgggtactagaaaagggaagggaagggaagggaaaaaccaaaggatttcagcttctctgacgattcagggtgtccagatttaagatggagttattttaggcactgaattgacaattccaaaatttgtgcagtccgaagaaactaaaactgaaaattagagacaaagcagttctttatttcaaccctgcaaacgtgtgtatgtttcctctgggataggaaagggacatcaatgggtcagtaatgcagaggaggagaactgaaaatgaaggagtggctacctgggctatgtacataattgtttttcatttttatagcaacctggtaagtaggtattgttatccttatttagtgtggaaaaattgaacctaaaggatttacagtcagctacatagccaatgtgtgagggccaaaattgcacttaacttcaaaataggtctttacaccatttaaaaatcaaactaaattggatcaagtgtagataacagtagctacagggaagcatgaggtgggtgagaattagccactctccaacgtagtccctgccaggatataatgaaagcaagtttcagactaaattctccacacacatacttttaaactgtattagcaaggaggccctaagcaattcatcagtccgttctgtaaacattcatgaagtctcaagtctttattcttttaggttcttctaccaccactctgcagaaaatatattgcagtcagcttaactatattccccaataggattctactacccttaaattcagcatcaggcaccagaaatcatataatccaccagcaggatacaggaccaatccagcctcaggcagcacaccaaaggcttcactcgatgactattccctgttcatacagggtcagggaagcctatttataccttgaatctcataagtagtgtctgtttttagaatttatttttctgatcaataagccattaatttcatcaatgaaaactcatttctgccattcattaattcatatcttaatcaatggacagtggagttgcatttattaaccagtactatgtctgaccttcctgattagatactagctgttcactcctaaagtgtatatttctgactaccccaagggtttaataaacaaaaatctacatttgtatcatactgtttatgatgtagtaaattatacatgtcaaagcaaaggacacaagcaaatccttagcccagacactagatgtagcgggagctcagctgaagactgaattactatcgcactagaattcagcaccatcttgttttgtgctttagttatctaattgcttcgtgtgttggatttggcttcttaatcagattatgaaattcttggaaagagagagttatatactgtttattcttctacaatagctagcacagtgctagatacatataggtctagaatcaatcatttttaattattaaaattcatagtaataccttacaaacacttggcccgtaggattctatagttgctttgagattctaaagtacctcagtggactacaaaccttaagaaattgcctgactgacttgagtgatggaaatggtatattttgtgtagattttctcatatcaattcacagctttgttctaacaattattaaacttcattgggataagcataaagtatgaaccataataaacaatcatgcacctcataacgatgttttggtcagctatggactgtatatgtgacagggatctcataaaattatactggagctgagaaattactactgcctagtgacatcatagcacaccaccttactcacgtgtttgtgatgatgctgttgtaaacatacctgccgcacttctggtcttataagagtatagcacatacaatcatgtatagtacatacttgacaatgatcataaatgtctgtgttacaagtttatgtatttactatgctatactttttattatttgagagagtacatcttccacttatttaaaaaaaaagttgattgtaaaacagcctcaggcaggtccttcaggaggtattccagaagaagacattgttatcatacaagatgatagctccatgcatgttattgaacctgaaaaccttccaataggacaagatgtggaggtgggacagtgatactgacaatcctggccgtgcgtaggcctaagctaatgtgtgagtttatgtcttaccttttaacaaaaaggtttttttaattaaaaaaaattaattaaaaaaggaaaaagtatatataataagactataaagaaagaaaatcattttatacagccacacaatgtatttgtgttttaagctaagtgttactacgaaagagtcaaaacgttttagtaattaaaaagtttataaagtaaaaaagttacagtcagctaaggttaatttgctatcaaagaaagaaaaatattttaaaataaatgtagtctaagtgtgcagtgtttatgaagtctccagtagtgtccagtaatagcctaggcttcatattcactcaaactcactcactgactcacccagagcaacttcagtcctgtaagctccattcatggtaagtgccctatctaggtgaaccatctcttaacttttataccgcatttttactgtaccttttctctatttatgtttagatacataaatacttttatgagccgggcattgtggctcacgcctgtaatcccagcactttgggaggccgaggtgggcagatcatgaggtcaggagattgagaccatcctggctaacacagtgaaaccccgtctctactaaaaaatacaaaaaaaaaaaaaaaattaactgggcgtggtggcgggcgcctgtagtcccagctacttgggaggctgaggcaggagaatggcaggaacccaggaggcggagcttgcagtgagccgagatcgcaccactgcgctccagcctggcgacagagcaagactccgtctcaaaaaaaaaaaaatacttttatgttacaattgcctaaagtattcagtacagtaacgcaccatacagatgtgtatcctaggggcaataggctataccaggcagtctaggtgtgtggtaggctacaccatctagatttgggtagtacgctctgtgatgttcacacgacaaaatcacctaatgttgcctttctcagaatgtgtctttgtagtgtgaccgtacaaacataaatactgatatctggcttcatttcaaaattttttaaattgagtttgtccatttccactgaatttaattatttcgagcaccaactccaggagcaggaagttagcactgggcttgtttttattctgagtactgcttgaatactaatagttgaaaagtattgtaatatttgaccctgaagagctttgactcagggattttgtgttgtcattcacatcctcggcaaggaaaggtatccagctcctactatttaatatgtaatcacgacatctagtgctcactgtttggttttgttaagcaatagctgtgagccacagagccaacctgcagccgcatctcacccaagaaggcccagggctgtgttttcagttttgcttttaatgattgcataactgtgtgaagttctaagacactgttgggattttagccttgggatgacaagcctttggggcacctctttggggtaaagaaagaagaactaacagaagagcttcagtttaagtctgatgaggacaaacgcctggcactaggtgggttttaaaaatccttgaaaattttttaaaaactaaaaaaaaagccagctcttttgcaattgcccagagagaggaggacacccatattgattgatgcattgttctcctaggcaggaatcgtcccactatagtctgcggtagcaagagttcaagggttaaagtaggaagactgatcccataaatgtaatttgcattccttccaaattcacatacaattgtatagcagtgagtatttaaatttaaaaacattatagtttaaggaacttttctcatgaacagttctcctagtgtacattatgtaaattctaccaccagagaaaaattcctgctttgttccggcttaagcttggtacatatatacaaacccatactattacttcagaaaattcaacttaggtaatctggctcaatactcatggttagagattttaactttaacaacttaacaatatttggtttatcatatttgtgcttttatttcaatttagaatgttttccagccagaaatctagctttaagttttataaagcatgatgacacagcagctagaactcaaatctctaaatggaattatgctaaatttaacaatatgttacctaaagtccttatgccttaaaatgtttctaggctaaattctgcaatttccctggaaacatattgaattgtcttcaataatacattgcataaatatatttatcctacatctaggtacttcaaattataagctagtaaatcttgtaatatttctagctttaagactcgtatgtatttcttcctttgtattttctccccaatcatatgattatgtactattgatgctataaatatcttatattttaaggttaggctaattcccagtggctctattatcccacctgtgcttgcaactcagtatgtgatgaaattgcctatgacttatcaattaacccttggtgtccctagaatccaaaataaagaataaatgtatgtaaaaggataattggagacttagaatctcttcctcaagattttatctggttaatgactatcacaggtgggctgttctttttattcttggaagaacatactctattccggaggggaaaatatcaaattagttcagcctgctacctgctcccatagaagatgggggaagctggctctttcatcggtgttttcgtctgtagccgcccccttccccaaccttgagttgatttaaaaggatggaagaaagtaccgtgctacctccaatgctgtcattcagtgttcaccccaggcagtgtgctagacacattcctggactaaatcctttagttcctttaagacaacaaacctataagataggtattattatctcgattttacatattaaaaaataatgtaagcctttttgtatttgcattgttttgctttgttctttaaatgtctgctttaaaaaaagaagtggggtaggtaaaggatcaaaaaaggcctggaatcccaaaagtaatgataaatgttctaaaaactctttaaaactttttatcttccatctaaacaggatgcatctgttacccatgctaattacacagaaggcatctgagtcttcctaacttctagcacgtaatagacaacctgtgattcctaacatttactgttggaatttacccattggatcttttctattataaatttatcttcacttttttgttgttgtttttccaagaagaggtgaaaatagcaatgccggctgggcatggtggctcacacctgtaatctcaggactttgggaggccaaggccggtgaatcatttgaggtcaggagttcgtgaccagcctggccaacatggtgaaaccctgtctctaccaaaagaatataaaaatgagccatgcatggtggcgcacgcctgtagttccaggtacttgtgaggctgaggcacaagaatcgcttgaacccagaagacagaggttgcagtgagctgagatcatgcccctgcactccagcctggatgacaaagtgaaactatgtctcaaaaaaaaaaaaaaaaaaaaaaaaatgcttgggagccaggtaatactcaaagaagaatgattgccactgggcttttctcaaacccactcatctgtcagtcacgtttgaaaattatttctcaggtcagatacggtggctcacgcctgtaagcccagcactttgggagacctaagcgggcggttcacttgaggtcaggagttcaaaaccagcctggccaacgtgatgaagccccccgtctccactaaaaatacaaaaaattagccgggtgtggtgtggtggtgggcacctgtaatctcagctacttgggaggccaaggcaggggaatggtttgaacccgggaggcagaggttgcagtgagccgagagagtgccactgcactccagcctgggcgacagaacgagactctgtctcaaaagcaaagaaaagggaaaaaaaaactgtttctctgttaaaggaaaggaagtagctcacctgactgacatatatgtgtccagaaatgaaatctttacagtgacctgttactgtcttaatgataaacattgaattattgacatctactttatctgaggcgttatcctaggaactttatatgcgttgtctgtaatccttatagcatccctcagaaccacattcttccccttctacatccttccttctcaggtaaggaaactgaggattgcctcaaagtcacatgactatggtaaagacatttttttcccacatgcttatgactaaatgttagtactcgctggaaacttcataccagacatcccataccctttggactgattaactcatagcaggggaacttgggccttagagtcactgttaattggaggttagtggtatgtggctgagagaaaattgtctgggaaatgcatttgcccttcaagctcagaacccagaaagcttttgtcagagccagccaggactggctgcaggattttggaatttcagaaattttgtgagatttttataatattaaaaattaaaatatattaaagtataattaaataaatcatattaaggatgaagtaggtcgggcatggtggctcacgcctgtaatcccagcactttgggaggccgaggcgggcggatcacgaggtcaggagatcgagaccatcctggctaacatggtgaaaccccatctctactaaaaatacaaaaaattagccgggcgtggtggtgggtgcctgtaatcccagctactcgggaggctgaggcaggagaatgacgtgaacccgggaggcagagcttgcagtgagccaagatagcgccactgcagtccagcctgggcgaaagagctagaatctgtctcaaaaaaaaaaaaaaaaaaaaagaatgaagtaaagaaatactcaacactcgtcacttcctaaatattttactattgtccatgctttggaggtaattgacatctattatatctgtgttgtggaaatactatgtaatggggtgctaccatacatcctttccaactttatgttcagtgacttaacattgctagcttgaaattagctatggcaggagcatttacaccatggaaatcagcaaatatgataaatcaatgcttgatttatcattttgttgcttgtctacaattaagaatgaagaaattattaatgcaaattaaacttaaaagtgtgttaagtctacagctgctacatgggaaaaaggaaatttttcttccaatattcaaaagctattatctgattcaccaaagaatttgctcatgtcattaacaaatgagtgtaattccaacatatatgttctttgtttcactttcttctaaattgttaaacaaaaatgtgaaccagcattcatgtgggaactatacctgctcatcagttgaaactataggttaactatggatagaaaaggctggcagaactcattgaaagcattctgtgaaatcagtcctctaaatggaatttattatttttaaaaatactattatttgtaaactatgtggtacacatcctttatttacagtaagcattttttttccatagaaccagttgtaaaacatttgccagaccactagctgtaaggtataactggtctgcaaactttgcacctgccagaaccacagagtaaaatcataccttccccaaaacaaaggcaccattttgaacacagttggaataggaacatagcttttaatcctgttgtttaaaaagagaagctaaaaagtatgctgactgcttttaatatttttcccattcgtccactagcaggagtgaatactgtcaagaagtcttcaaactacccaaaagcaagttgaagataagcttctatgaaatgtcatgcatttttgtagtgtgtgtatgtactatgttttgctaaagaagattatagaatccatctcctggactttggggacttggggggaacagtgggaggggggcgagggataaaagactacaaatgtggtgcagtgtgtactgctttgatgatgggtgcaccaaaaatctcacaaatcatctggtatgtaaccagataccacctgtacacccaatagcttatggaaaaatagaaatttaaaaattaaaacattaataaaatatgtataattatttaaaaaaatagtatctatttccaagtatctttggcttaagcagtaggattttttttccccaaagaacagtaagttaatgcactttacatgttaatatttccagctaagaaaacattaaggattgaaaattaggaatttaagctggtctcatatttatttagttgagtgaattaaaggggggttaagagtttatcagtttctggtgttcttttacttctaccctgtaccactctctagaaatacacttgtgatctgtgaattgtcacgcatatcgttatatgatcatttacttaagtctactttaattggttttggatcgtttccacaaactatgtttctgcattacattccacattgcagaaggtggggctgctctgttgagtttcgcttataaataagcaaacattctttgacctgcaaaattccaagaacagccctccttcctacctgacccttatatatttctaacacttgttaatagaaaaattgaatgaaaaaaacaacaactaaagatccttccaatattttctggaaaattgatttccttttgtgggagttggagtgtctaactggaagggataaaaataatacctgagcaagttatatttgactcatatttgaacagtcatctaatggaagacaaatctatgttcgcaaagtctttgtttcccttagggaagtaagtggattgccaaataatggtgggaaatgcttacagtgcatattttctttgtgattatcaggcagaattttgttctggttttgggattcaaaatatgccaggttctttattttcttaggatgtccattttacctagttcattgtaaatgacactgaaaggaaaccccgatcaaagtttttggcttcctggaattttgctgttgcttgggggaaaagcaatgcttttttttctgtttggatttttcagtggcatttaaggaagcaagatgaaataggtaatccatacagaaataatcatcttgtttttctttttgaaaatcactggtccaagaaagatacaatttaaatccaaggtcattggcattgatcagaatagatagctgatacttttcctgaaagatgaaccataatattttagcatcatgaagcccaggaatgtgagccacaagaacctgggtccaggaaagtcatgtaaatccattctggcttggccacagctggggccttgactagagttaccgttttcttaaccttaaagccacgccttggactctgcttcctttaatctgaccagactgtcttgaatctaatagtatgaggccatgtatttagggtcagttagctgattattgagtacccactatgtgcttgctactgggttaaacatgatagcttccttatggaatttacatttgtcttagtccttttgggttgctataacaaaataccttagactggccaatttataaataatagaaatttatttcacataattctggatgctgggatgtccaagatcaaggcatcacagatttggtgtctggcgagggcttgctgtcacccataaatggtgccttgtgactgtgtccttacagggcagaaggggagggcagctcccttcaacctcttttgtaaggacactaatcccatttgtgaagtcagagcccttgtgatgtaatcaacttctaagggcctcacctcttaacatttccacacttgggtttatgtttcaacatatggattttggagggacactagtgttcaggccatagcaacatttagcctagaacagcctagaaatgggtgagaattatttcctttattcaactagaattgattgaatgcctatcatatactaggtgctcttccgcatactgaggattcaaatgcgacaaattccaactcttgtctaagaggtgcaagagagtgccatgagagttcagaactaggacaactaatccagctagaggcatccagggtactttccggaagaggccaacactgagtgggaagtcagagtcagccagatgctataaggagggctttccggagagaaggctgtccatggacacggccagtaaaaactcccaaagtgtgacagcgtgacgtgtttttgaaagaatcgagggctgggcgtggtggctcacacctgtaatcccagtgcttggtcggccaaggcgggaggattgctttaaagcaaggagttcagggttacagtgagctatggtcccatcactgcactgcaaactgggtgacagagtgagaccctgtttcaaaaaacagaatattttttctctatatccacaccttgttggatatgcccacaatttggggccatttacagatggagtggggggccacagtgatcctaagagccagggagggaggagcaggaagtgggaaaggggtttaagtagacagcttccagagccccacttcgctccacctctacctggatttctgttcattcaggtctcccacaaccaagaggtgtctggtgagaagatcagtaaatcacctcattttgattccacattcgtaaagaactgaaaatcgctatttcatgacctgcgcttttcctcgcagtaaccctgagagtttggaaaggggcattaccaccaccacattatggatgaggaaattgacatcctcagtgtgagcgatgttgctgggtccacagttcaacatggcagcgctgggactggagctgtgtttcctgggcctttgggcccaggcagtagagtataggtttaaatcttggctctaccagttgctagctagaggatataaagcaagttccttaacctgtttaaccttgcttcctcctctgttagatgagcttcaaaatagtacctcctaagtggttgtgaggattaaatgagatcatgcacataaagtgcttggcacatagtaagcactcaataaatatttattccattaataggcactgaatcagattctgtggttgcaaaactgggtgtgacacgagtacaaaacagagacagacaactacataactggccatatagccaggggataggctctgagtaagcacttagcacagcactttgatggttctatttgggataggggcacagcgggccaaaagctttcacagagaagatcctattaggactttgacccagaaggtagaatttcactccccttgaaagggcaagtccaactaaagagatgcaattctattagttacctattactgtacaacaaattaccccaatatttagcagcttaaaacaacaaacttttttttttatctgacagtttctgtaggccaggaatctgggcgcaggataatggggtgcctctagtttaaggtctgtcagtcaagctgtcagtcagggctgcagtgatctccaggctggactggggcatggagaatccgctttcaagctcactcaggtgtctcttggcgggtctgaaaaggtacacttccaagctcactcgtgtgactgctagcatgcctaggtttctcatcaggtactttctttatcctgtagagatggagtcagcaaactttttatgtagagaaccagatagtaaatattttggactttgccagttatggtatctattgcaactactcaactctgctgtgtagctcaaaagcagccacagacaatgcataaatgaatgggcctagttgtgttccaatagacatgtatttgttctctctcttgctctctactaaaactgatagcttaaccaggatatcaaaatacattacaaacctcatgtagaatgggaaagatttaggggacgacaacttaactgacagttcaggttctttttggtaatacatgtagtcttagtcactggtggcatggctggccagctttggggcagagtgacggactcatggcagcagggcccttgcctgccataagaaaagacaggcccggaagctgaagggccagtggcatcataattacatctttccagtaattgattgcttgacctgtgccaatgtaacatatgtaacccataagattgttcttaaggctcataagatatagatacttaaggactcacagagagtgcagtgtctacacaggtatgttctgccctccagaatttcccttaaataattgcacagaaatctgtccctaatatttccttttgcattacatgtatggtgtacctagaatctggcttttctaaaacaactagaacatcagcaaggtgtctcagaggttgaaaagaggcctggatgattctttgtgcttgtgtttgaggctgtcaatatgttaaagtagtaaaataatgacaaagcagcattataaacattgaagaatattttaaatgcttacatgtacaaatttgcaatattatacacatgcataaaagtggtagaattttcctagtctagaaataacataaggaacagcaagtgatttgttatagaaaaaaaatgaggctgaggtttaaagatacatgaagaacattacctttcttcagtcctgtcagtgcggctctgggcatgtatttggagatagtgtcaggagcctacatttgagttctctctttgacaggaagtccaagttattcaacttcctgtgtctcacattccctgcctagctctgcagtgataggctttgttgcatgcatccaccatactgaagactccatgatatataataaatgaagaagcttaaactctgaattctttctccaaaatatattagttgtgtaaccttatgcaagttatttaggcttgctaaaccaatttccattatcgtaaaatgaagctaggacactggaatgcttatttcacacagagttgctgggaaaagaacaagatagtgagtgtaaagtatcaaacacatagtgaatgctcaagtgtcagataccatcaccatcttcaccgtcatcaccatcaccaccacttccactgtcaccaccatcaccaccatcatcattaccaccacaaccctgtcacacacacacacacacacgcacacccatgcatcagaaccagagcctcaaatcttggtttgaaaatctgttgagtgtaacaactgggactggatccagtgaagagtcttatggttataacctccctgagccctcctgcatgtgtgaactgttagcaccacagccgcagtgacttggccctgggttctgcttcattccaccctcacctgtccttggtaaataaacatgtatgtgcaagacagtttgtacatctcagacaaatctcttctgccacatgtgtgagaaaattgagacagaataaggactttataactagaaaagataaaatccaaagggcattggggcatctgcagattcacagaatgactgtcagtcatcattcttgggcccctgatgctaaaagagacacaccttgccatctccacctgggaagagcttgtgctgcaaagagagagaacatgatgaacttaacaggagttaagaatttggctctgattccctggagtctgttaggtggggtctttagctgtttggaaaagaagggtttctgcctgggacaggtaataattgctgaacagactttccttgcactttccctggaggtgtgaatttgatagcagtgatgccttgcagattatcatttcctggtttatgatggaggaacttaatctcctgtttaggtttctaactgccaggtcccataggttacttacttcacaacagaaaaatagaaaagaatggaaagataaaatcaaattcatctcacacattaaaatcatggcctgttatagtcagcactgtagacactgaacttggaagctgcaaggagggtgatattaccaaaaatgttaagttccaaaaatgttaaactctagagagaatggttaattaactgtcaggggtcactgtagggtagatgcatgtcgcaatgataatctatgcataccctaagaatgacccccacatagcactcgcacctgaatgtgtgtttggagttccaagctaaggaatctgggagtggccaagccagagattcactccttatctatgaggaacatctgagcccccagccgaccctgtgaaaaacagaccatacatgggattaaggcccttggttttcagttaaatgaaggttaagtagaagctgttaaaaggaggatgttacgtgaaaaatgttatataaacgacatgcttctcttgagtggctgtggttatcgcgttctgctgccactggtcctgtggttctcctgttcagcctgctgccactggtctgtcctgatatgtaagttcccctctaaaccctgtggcagccgggcgcggtggctcacacctgtaatcccagcactttgggaggccaaggtgggcaaatcacctgaggtcaggagtttgagaccagcctggccaacatggcaaaaccccgtccctactaaaaatacaaaaattagccagatgtggcgcacacctgtaatcccagctactccagaggctgaggcaggagaatggcttgaacctgggaggcagaggttgcattgagctgagattatgccactgcactccagcctgggcgacagagcaagactccgtctcaaaataagaataaacataaaccctgtgtcgcattcactggctccaggtctcttcttcagcctctcggacctgctgccatcctcactggaattaatggggaattggcatgacaatcactcttggaataatttgcaagaatttaaaacaattattatgaacattgtgtattttcatggaaaaggccagagacgtgatgctaagtgaaaaaaatgggacatgttgtaaaatgatcaaaacagggtatttagcatatgcaacagcacgcatttatcatttctttatcataagaacattcaaaagcctctcttctaaatattttataagatactacaccttactgttactaaatgtgaaaaaaataaaaattaaaaaccacacaagaaaaagaagtgggacacgaagttgtatgtgtattgtatagaatttgtatgcagatggacataaacccttgaaaaaatttgcatacataacacacggttcagctgcactgattatggttgaccttttttcctctctttttccaagttttgtgcacttatatgtatttgtgcatgcgtgcataattatatatgttttaatgtagagtgtataaatcacattatgtatatgcaaacatatataacatttttaatgaacaaaggtctttaagcatttggaaaagaccagatctgagcagagcgagtgcaaaaagaaagtttttgtactttaaaaactacttagaatttggcataaactaaggactaagctttaacgttaatcgataaatgagtgaatcttacattctatcccgaatatgattgtgctttagtgaagtaactaggatttttcttttttctgtggagattctagatataaatcacggttttgtttctttggtttaaattacattcctctttgatcattacttcacacaatgaaaagatatttccttgtgcaaagtagtggttaacttctcataacctctgacaacaaagagcccctgtgtgaggacacaggaattcctcttgggatacagggaaggcccccagctgaatcgtatccaaggaagatgttgcaaagcttgcaaagcttgttcagaaaaaggagcccagcttgagctctttgctttctattcagatattggccccatgtagaggtgggggtgggagttggggggaacccatcaaagagaaatgggaaacaaacctgactgcatttacagattacaaggaaaagttaattcttgcaaccagtgttagagccaactcaggcttattatatttagaatttaactccacttggaaaaaaaccccttttttttttttcctttcatggaagttaaagaaggtaacacaaacagcccgtccactctgtggtgtaaactctgaagtaaaaaacacctgtctgcagagaagtcccaggctggctgagttcaccttgactagctctatttttccccaccagtgagtccagcatgttcccaccagttattattatgaactgaaatctcgcagagtcaggcatttggcatggtattcacggcctctccccacctaaccccagcccatcctagtggatttatctcccatcatgcttccttttccaccacccacaaaccttcccttcctcccatgctttaactccccacccccaaccttgttgggaggacttatagaacgatataaagcacccacaagtgggtctggcatgtccaggctttcagtaaatgctggtgcccttttcccttcttctctttccctttgcacaaaaagtcttcctattagaggtacttaagtcttgggacaatgatagaccctttaacagggtggtgatgagcagaaatgagcgaggaggagagtctgccctctccgccctctaccagcccctcttaggggcctccctctaccagcctactcatcaaatgctgcacattaataacaattagccacatggccgctgccatttttgtgcttctgccaccagcttttcctggttcatgcattatgtgtacacctcatgtgaaggaacgaaggaacagagaggttttgagatttttcttgaggccacacagcttataagtagtggagccgattcaaattcaggagtttctggctctagagctcacccctcttttccacttgtgctgaactcctattaacctcaatagggaaggcaccaagttcaagaggccgaaaaagacatctagagccaggaaatgagacatggggcttatttggggcctacatacagaggagagagtccagtggcggcaggctggacaatataaccacattgcccagtggtagcggactaggcaacttgcaaacagcatgcactctatacagcattttcacttaccctccccttaataacctccacctggcaaccttcatttaacccaaaactcaggtctcaatcccctgtacagcgcatcttccattggacaggccgggtctcagatgtttatcatagataaggaaggaatctctgaggtggtcactcctggattccctagctcagaacacacattcaggtgcatctgtcattcagggtcattctaagggcatacttaaattattaccaccaggtgcatttaccctgcaccactatgcaaaagtgtcttcccaaagactcaccgacttttggtcaccagcagcatttgtccccaacacctgtgggtgctcaaaccgtatcaggagaagaaataccccctcctagttcaggggtggctccacttgaaaaataacattctacaaagtaaaaattccattccatgtacagataaattgcacggataaatatcaagcaagaatctatttgctaacagaccacggaatgttgtccttcgggtgtttaatgttgtacttgaatatgctgtaaaaaacgccatttaagaacgtgtagatcagcactatccaatagaactttctgtaatgaggaacatgttctatgtccatactgtacaatacagtagccactagccacatgtggcttttgagcacttgaagtatggctcattagtgtaaccaaggagctgaaattttaatgtatttaattttaagtaatttaggtagccatatgtcgttagtatttaccattttgactgtgcagctccagaatattcagaaagattggttgtaggacaccaccccaactccattttcatagtgttttgcctataatctctattatatcattgcatctaattgcttaggtgcacccaccccactaaattataagcttgatgtcttattcatctgggctgtgatccctactagcatatggtctggcccgcagcactagatgtttaataattaatgcaagttaaataaatggatgtgaactggctcattcagaagccagattcctactgcttgctatcatctaattcactctttctcatgactttctcttatgactagactggtccccaaatctccaggtcaagcccagtctgctcacctgtaagcacatttttcttttctcaaacgaaatcgctcttttaagtgattgttttggtatttgcctctttctctctaaatgcatacttctattactatttctttggtgggtttttttccataataggcatcatcttccacagtggaagaagctaccacctccagccctaccatacataaggaatgccaccattctccactgaaccccctgcctttaatttgggttagaggaattttataactgtgtaaatacttttgaaagctaaaccagggagtggattaccattatatttccttttctgtacagtgtttttctgcaggtagcaaagggcttgtttctcatttattgaatgttctgtatacctaccactgattcaacctcaaattatttccatgttgtataaatctttatctttgggacactttagttattctgttcatttcatctcttgaaagaaggctgcctggctgggcgcggtggctcacacctataatcccagcactttgggaggccgaggcaggcggatcacgaggtcaggagattgagaccacggtgaaacccatctctactgaaaaaaaaaatacaaaaaattagccgggcgtggtggcgggcgcctgtagtcccagctactcgggaggctgaggcaggagaatggcgtgaacccaggaggcagagcttgcagtgagccgagatagcgccactgcactccagcctgggcgacagagcaagactccgtctcaaaaaaaaaaaagaaggctgctagagccttcttagcttctccaatctgaacaagctgtgccctctcttgtatacactggaggcattctgggatctcccatcaccatcatccttggtaatacttttgcctctcttctgtgtttaatgccctattttatctatcccttgtcattccctcttggtttactccctcacttgttttttacatcttctagtaacttctgatagcctgagaaaagatatatggatgataaacgttttgagacctttcatatctgaaaatgtctttatcctaccctctcacttaattggtagtttggccagatttagaattatttgtgtgtatatatgtttaagaagtccaaaatcatgctgatgcccagctctttgtatatcattgagttttttttgttttatgtttccctgggaggctactggatctttacttttatcctacttctgaaatatctcagtgatgtatgttgattttgattctatttttaaccatttcactgggcagttggtgagtcctttcaatccagaaactcatgtccttcaattacgtaaaattttctcaaattattttgtgacgaattccttcccttcttttgtttattctctcttcctgcaactcctattatttggatactggatgtcctggattggtcttctaatttttttttatcttttttattcaattttaaatgactttatctcttttgctaatttatgtgagatttcttcacctttttcttctagattctctgttgaaatagttatttttgctcttttgttttaatttcaaggagctgttttttttgttctctgattaaaaaaaaacatagctttcagtttgggggaacaagtaacatgatgaggatgttattgtcagtggcttggggtttgggttgggggttggttttttgtttgtttgttgttttggattttcttttttctattctttgtttcctccaagtgctttttgttggttgcttggttcttttttgtttttttttctgttttttgtttttttgttttttttgagatggagttttgctcttgttgcgcaggctggagtgcaatggtatgatcttgggggcacaacctctgccccccgggttcaagtgattctcctgcctcagcctcccaagtagctggaattacaggcatgtaccaccacacctggctaatttttgtattttcagtagagatggggtttctccatgttggtctggctggtctcgaactcctgacctcaagtgatccacgcaccttggcctccccaagtgctgggattataggcctgagccaccgcgcctggccaggttgcttggttttaatctctatctttatggtagagacttttgttggtagaaggtagctgccaggcattctcacagaaacaaggaggggagcaggctgcagtccccaacatttcctgtgcatgtgttcacttaatccccctgtttttggtatgaaacccctgccctccactgtgtgtcctctactgttgtttccagtccagaaaccctgtttcaccctttcctgacactcaacctgcattctttggctgagacggaaagtagaaaccactctaaggagtgcaggaagagatttggtaacctgacttcttaaaaaccttccaaactattcttattttagtcctccataattcactcttactttccttgggactttaaggattctaccatctaaattgggctaatcctttgttttccagagtgctgatttaagaggtcagtgactttactttctgtttttacctcctctattgctctccctttgggtttctgcctttgtttcaatgggaggtagttggacgtgtttgtcctgtccatcacctttctgttgtcatccccccattcattgtttcagctcagtaggttaactgataacttcaggatctctgaaactctgtatattgtcctcctgccaactgtctcatttatggaaccactgttcttccattctgtcagcctccaaaaataataattctaataattccttcttttatcatacaaattccttcttccatggaaatctggaactttttcccttaaaatatagtacatatttacagaagtcctactttgtatttctttttgaagaaataaagataatgagacctgatccttagattcaaggaacttccattgtagtggctgggagaaaaactgcaaactaatagatgatgagaaggaggatggggatgatgatgataacagtgatgaatcaagcaacagccaacactgttgaaattatactttgtaccgactgtgctccataccttactgtgttctttcacttaatcctaactactgtctgaaaaaggtactgagggaacagaaagaccctctcatattgttttatattgttttatactcagtacctgttttaagaaaaaaaacaaggaagtgaaatcaaagacaggcagcctggcgccaggcctaaaaccaggactgggcctgcctggcctaaacctggtagttaaaagtcaactcatgacttagaacccaatgttacccatagatttcaggcattgtatggaagaacattgtgaaactccctgctctgttctgtttcactctgactaccagtgcatgaaacacctgtcacatgtcccctagattgctcaatcaatcacgaccctttcacgtacaatctttagtgttgcaagcccttaaaagggatagaaattgtgcagtcagggagctcggattttaagacagtagcttgctgatgctcccagctgaataaagcccttccttctaaaacttggtgtctgagaggttttccctgcggctcatcctgctacatttcttggttccctgaccgggaagcgaggtgactgacagatggccgaggcagccccttaggtggcctaggcctgccctgtggagcatccctgcaggggactccagccagcctgagtgacgcgatccaaagaccgctcccaggtaggcaattgccccggtggaacgcctcgccacagcagcacgtagcaggcccctgcagtggctgagcaccaggaaggaactggcatttagagtctggacatctgaaactaggtaagaccagtctttggaacttgcccactccatttgagtggaagtgtggcctgatcacccacggcatgccttaatcggcactttgatgttgattttgggtttgacttggtttgaattgcttgacaggactggtcttgggaacttgcccactccatttgagtggtagtgtggcctgatcacccatggcgtgcctttatcggcactttggttttggttttgacttggtttaaattccttgacaagactggtcttgggaacttgccttctccattcgagtggaagcatggcctgatcacccacggtgtgcctctaccggcactttggtttttgtttttgacttgacttagattgcttgatactttggttttggttttgacctggcttggatttctggatactctgattttggtttggtgtgaactgcaaaagtgtgtgtgtgccctttttaagtgttttttgttttgtggtgtgcatgtggtgtgagtgtggtattttgtctcaaagaagcataggtcaggcacaaataagcccaccccactaggaactatgttgaaaaatttcaagaaaggatttaagggagattatagtgttacatgacaccagaaaaacttagaactttgtgtgaaatagactggccagcattagaggtaggttggccaccagaaggaagcctggacaggtcccttgtttcaaaggtatgacccaaggtaacctgtaagccaaggcacccagaccagtttccacacatagacaattacacctggttttagacccccttccccacccaacagtagttaagagaacagcagcataagtggctggcagaggcaaggaaagaccagcagggagaaaaagaggccatctataccaattctaagttaatttagactaaacaaggtcttattaatagcaaaggataattgaaatcccaaacttacaaggttttcaacagaagtgaagtttgctaaaatttaacagcgtaacatgtattatggtaacttctaatcttgtggccttacacagtctagtccaaagacacaaagaaagttctctttaaaaaaaaaaaaaatggttatcttcaaaaaaaaaaggaaaaaaaaagggggggaggcagaatttatatcaaaagagtgttatatggtaaattcttgtcctgaaataaattaactggttgtttaaagaaaaaactacttgtaataagtcagaaagttgagacacgttgaaaaattgtctgtgaaagtcgtgaaagaaaaaaagttataaaaaaaagttatgcaaaaaatgttgtataatttaaaagtaataaggcctcctgagtactactgaagaaacagtttatgtgcaaggtgtataaagtaaaatatatctttggtaaaaatattataaggaggcataagaatgtggatttttacctacattaaaaggttaaaaaaaagttattgttttaaaagtttaagcaagttttaaaatgttaattgtaaagaaaattctgtgtataaacatattagctaaagttaaaaaggtatcatccagtttttctgtgaactggatattaaaggaaaaatgcaacaggtttttcttaaagcatcaacctgctctttaacaaaaattataaaaggttaaaaaaaaagagtctataaaatcttaccttatggtcaaacatgaaaaattggataaatatgtctacaaggttttattaaaattaagtttaacattaataacacactaatataaaggtaaaatttagtttatctggtataaaaatcatacaagaaacattattaaacataaaatggtgtttagctttctttggtctaaaaactaataaaaataggtgctaaaagaaacattcattttactagaggatcataaaagttaaagacttaaactttggcaattaaaacagcataccaagatgcaaatgtctggttgaaatggatcaaatattccatctgcatgttaaacaaaagcaattgtgatgcttgtgcacatggcagaggccctgtttatctcccttccactaaggtggtcctccagtcgaccaggcatgggctgcatggtagctcttttccaggattctacagcctggagtaataagtcatgccaagctctctctgctatatcccggagtccctgcaggtcagacccgagggccatccagcctccatgccccaacactaagttcacttcgtgtctctcaccacagggaggaaacttagcattccttggagacctgaagtgatgcgatgagcttaagaattttcaagagcttatcaattagtcagcccttgttcatccccaagcggatgcgtggtagtattgtggtggacctttactgggcactctgccaaataactggagtggaacttatactttagtccaattgcctatccctttcaccctggcatttcatcaaccagaagaaaaaaaaaatggcatttggagttttaacccagactgtagggccctggccaaggccagtggcctatctctcaaaaacaactagctggggtttccaaaggctgacccccatgtctaaggtccctggcagcaacggccctgttagcacaagaagcagataagctaactcttaggcaaaacctaaacataaagtccccccatgctgtggtgactttaataaataccaaaggacatcattagctaataaatgctagactaactagataccaaagcttgctctgtgaaaatccccgcataaccattgaagtttgcaacaccctaaccccgccaccttactcctggtatcagagagcccagataaacataactgtttagaggtgttggactcagtttattctagtaggcccaacctccgagactacccttaaacatcagtagactgggggctgtacatggatgggagcagcttcgccaacccctgcaaagtgactctgaagaagacagcaagccctgctccagtcacacccagaagctgactggtccacacaggccgaagcatgaggaaactcatcgtgggacttattttccttaaaatttagacttgtacagtaaggacttcaactgaccttcctcagactgagggctgttcctagtatatacatcaagtcactgaggtaggacaaaagattgctacagtcctattgttttacagttattgtgaatgcctaggaactccaaaaggaacctgtttgtataataacactcagtaccaagtatgtaatccaggaagtgaccagcccgatgtgtgctatgacccctctgaacctcccatgatcacagtctttgaagtaagactaaggactggtccttttcctggtgacacaagtaaagtaatagctagaacagaagaaagaggggtccccaaacatgtaaccttaaaatttgatgcttgtgcttctattaatagtaatcagcaaggaatagggtgcagttctctagactggaaaaaaaagttacacagtaaaaaaaaaaattaagtatatctgtcaagaatcatatttatgtgagatgtgtcaatactggtcttgtgtcatttggacttacttggaaacaggattaaaaaggtcctgtttggctccagaaaggaaaagcagccccactgtgggagctgcagccctttagaactggtaatcacaaacccctcacacccaaaatgaaataaaggaaaatatgtatcattgagcattgatggaaaaggactagatcctagtgtaaacatcttaataaaaggagaggttcaaagacgctctccagaacccgtatttcagactttctatgatgaactaaatgtgccagtacctgagattccaggaaagactaaaaatttgtttttgcaattagccgagcatgtagcccagtctctaaaagtcacttcgtgttatgtttgtggaggaactataacaggagatcaatggccatgggaatcccgagaattaattcctacagacccagttcctgatgaattaccggcccaaaagaaccaccctgacaatttttaggttctaaaggcctcaattattggacaatattgcatagctagaaaaagaaaaaattcactcattctgcaggatgatttagttgcctaggacaaaaactgtaataatagtaccataaaaaaaaaacagttacatgatagagttccagttacatagacagagatccattcagtaaatttccaaggttgcagactgtctgggcccacccagaagtccactgggactggactgcccccagtgggttatactggatatgtggacatagagcctatgctaagctgcctgatcagtggacaggtagctgtgtaattgacaccattaaaccatctttctttttactgcccgtaaaagcaggcaaattcctgggtttccctgtctatgcttcccacaaaaaacgaagcgtagccataggtaattaaaaagatgataaatggccccctaaaaaaattatacaatactataggcctgccagctagacacaagatggctcatggggatactggacccccaattacatgctcaacagaatcatatggttgcaagctgttttagaaatcatcactaataaaaccagtcaaaccttgactattctggcccggcaaaaaaaccctcagataagaaatgctatctatcaaaatagattggctctcgactacttgctagcagctgaaagagaggtctataagaaatttaaccttactaattactgtctacacatagataatcaaaggcaagtactcaaagacatagttagaaatatgacaaaactggcacatgtgcccgtaaaagtgtagcacagattcaaccctgaagccatgtttagaaggtggttcccagcactagaaaaatttaaaactcttataataggagttataatagtaatagaaacctgcttactgctcccttgtttactacctgtacttcttcaaatgataaaaagcttcatcgctaccttagttcaccaaaatgcttcagcacaagtgtactatataaatcactatcaatctattgcacaaaaagacataagtagcaaaaataagagtgagaactcccactaataaaaagtgagagtctcaaaggggggaaatgagggaagagataaaccctctcatattgttttatattgttttatactcagtacctgtcttaagaaaaaaaacaaggaagtgaaatcaaagacaggcagcccggggccaggcccaaaaccagacctgggcctgcctggcctaaacctagtagttaaaaatcaactcatgacttagaacccaatgttacccatagatttcaggcattgtatggaagaacattgtgaaactgcctgctgtgttgtgtttcactctgactaccagtgcatgaaacccctatcatgtatcccctagattgctcaatcaatcacgaccctttcatgtaaaatctttagtgttgtgagcccttaaaagggacagaaattgtgcacttggggagctcagattttaagacagtagcttgccgatgctcccagctgaataaaacccttccttctacaactcagtgtctgagaggttttgcctgtggctcatcctgctacagtactattatcattgtcattttatgcataaggaaggagctagtgaggctatgtaactcttgtacaatactatgtgtaataaacatataaaccaatgtgctaagagaaaccaggggcagtagaaattaactcaaaaatccaagaagtcttgaaataaaatcacttccaaatttgctccttcctctggattccctttgatgccaccacacgccaggcttttttttatctcatcattaaattgaaagggtaaactcttagcaagtctttctgtacccaacccttttcattttctctgcttaccactggtaggtcatgctttgtaatatattgcttccatcttgtcattcaccacttcagaacctaatttgtttgcctatcatgccatatttggtcttctggacctactttcagtaacctggccatataggccatatccatcttgtaaccccaaaatccaacatgggtctctccattgtctttcacacaagtcctgttcttttctacctttttgcttttactaaaactgtcctctccgcctaattaatttctacctatctctcatggcctcatttttccataaagcctttcctggcagcttcgttgcagtgggattacattttctcccaaactcccataacgcttagtgctgactggctgtaccaggcatcaggtcttccccatgtacaagcaatagcttgcccaacaaatgagttatttatacttgtatccctgtatagaaacacatattttccaggcaccagcagtataccaaaaaatatttatttttgaaaagatttatcacttcaaaaagtcattctgggaaaaattataacttctttgatgcatcttatttcatggttattgttattttgacacctgatctttatagttcttggagctgataaacttcttactttacccctggatgttgttagtttcatcttagaaggacttctttgtataactgtgcacaacgtagacacttgtttgatatagggtattgtttgtaaaatttttgcataatatattgctgaaataaactataatatgggattaatgccacatttcattaaatattagatgccattgattgtaacatgtaccattatcttacgtaacacaaagatagaaaataatgctgccaatgtaaccatgatgtgccaatgattgctagatacattccaattccagatatgttaaaaggtaaatgaatacacgtacatcttagaatcgataaaatgtgagcgttgttgtgttataatattatgcattggtattaggcatctttaaattgccaatgatatttttaagtcaaattttttaaaacatgcaaggtaccacctatatgcaagtcactgtgccaagggacacaatgtgcagataaacactgatgaaaccatggctttctctactgagggtttatagtctgatagagggaacattgtataaatgaattatgtactataatccaagacggaaagtgatcagagctatccaccttgatacagtgatatagtttggctgtgtccccacccaaatctcatcttgaattgtagctaccataatccccacgtgttgtgggaggtaattgaatcatgggggtgggtttttcccgtggtattctcatgatactgaataaatctcatgagatctgatggttttataaagggcagttcccctgcacacgctgccttgcctcctgacatgtaagatgtgcctttgcatctgcttcaccatccgccatgattgtgaggcctccccagccacgtggaactgtgagtccattaaacctctttttctttataaattacccagtctcaggaatttcttcatagcagtatgaaaatggactaatacaaagagcttaaagatcctttagaaatatttatttatttatttatttagaggcagagtcttgctctgtcacccaagctggagtgcagtggtgcaatgagctcgctgcaccctccgcctccaggttcaagcaattctgctcctcagcctcctgagtagctgggactacaggcatgtgccaccacgcctggctaatttttgtacttttagtagagacaaggtttcaccatgttggtcaggctagtctcgaacttctgacctcaggtgatccacctgcctcagcctcccaaagtgctgggattacaggtgtgagccaccacacccggcctagaaatattttaaatagagtaattacctttattttggaatttttcaaagtcttcctggagaaagtggtgtgtgaaatgagttttgaaggatgaatagaattttgcaaactattgattggtaaggaggtatgccaattggggaaaataatatgtgcaaaggtatagaagcattggcattaaagaataatgaaaagtctagtttggctggaaatagaaagtagctggaggagttccccagataaactaggaaggccatggatgtcgtattgtagaaggccttgaatgcatagctgaggatatttaagatttggtaggcaatacggaaccacttaaggtcttttaacagtgcagtggtttaatgagagcttttcattacatagctggctccatctcatcttttagatcccagtttaaatgctaccctctcagagggtccaaccctcactctaagtgaattctcacctataactccaaattgccacatccagttggtttcctaggaagcacttaccactggttttgatctgtctaccaaccacctggtaagttgcatggtagggcaagtagggcgttctgttcccctttcatactctcagtgcttagcactctacatggcacttcttaggcactcagtaacagcttactaagtgtgcagacatctgagagtagcttctaacagacagttggatactttgttcaaaacaaaaacaagaattatgtgacgttatcaattcatagaggacactctgagacaggaggccaggaaacaagtcctggctcctccctaccgattccttgcatggccctggataagtcactaagactcatgccctctggtttgtttatctttccgaaaatggttgtggaggaactgactgctgaggtcttctcttcagaaatgctgcatcatccacatgcaaaatatgggtctggtgcttaggagacaaagggtgtggctcgagaggtggattttggatttgttctacagggaatacagtataatcaaagtcaagataaggatccagtttttaaaatggtctcgatcctctgcacagcatttgatgctgttggactggtagctgttctctttatctgaggcactgtagagccctgtacctcaaaccttttctactgctgcttgtctgtttctttcacccagaacccttcaccccacagatgtagatgttcaaatcatatggttctgccttcttccctcttcacatctcactccctagggtgactcttaacactccatggaaatccttgttccccctgagtctcctccttaaacatcaagcaatccagaatatttactgctcccatcaggctgttattctataggatgcaccacctggcatcccaccctattctttccacgtttcattaaattttctaacagtctttcactacagtttttgttacctaaaatctgcagtttcctgtgcatagcatagggcttgtcacacagtaggaattcagaattctttgttgactaaatgatactccattctttctgcctcatctctgtcacattccccttgcctaaaacgccctcccgacacacctggtcactattagtttttcttttttattttctttttcttttttttgttttgttttgtttttttgtttttttgagacagagtttcgctcttgttgcccaggcaggagtgcagtggcaccatctcggctcactgcaacctctgtccccggggttcaagcgattctcctgcctccgcctcctgtgtagctgggattacaggcacctgccaccacaccaggttaattttttgtatttttagtagagacggggtttcaccatgttggccaggctggtctcgaactcctgacctcaggtgatccacctgtctcagccccgctgagtgctgggattacaagcatgaccacgcccagcccctttattagtttttcatccgatatgattcctctctgtttcagtgcctggctcaggtactgtcagcttctggaagcctcccagttacactctcttccctacctgaaccacctcaggattttgttggtgtccccttgatggcattgtttgtactctgaatgatattgtagttcattgtaagctcttctcacctctttgcttttccctgctagagggttatctccctgcaggcatggacttgtgtttctcatggcttccttatcaagtaatatttaaatgaattgtgaatactatgataaaaaataagaataatagaataatcatgggacaatgtttgagcagtgtatcagagcttaaggagttactgaacaatttaaagaaataaccaagtgagaagatttcgctgacgagaatataaaattaaatcactgaaagggtgtaaaaccattccaatatcataagacagagctcattatctcgatatacagtctacttgggagtggaataagagcctttcttgaaaatgatgtgtccatgtgtagtaaattattctaataatcatggagaagtgaatacaaatctgaacacttgttttactttcttaagttctatacatcataaacaaagatattttctaaatcatgtattttattgaaataccacacatttattcattcaattttgcttgtttttgttgttgttttgtttttttgtgggatttttcgcttagtcaaaactttgtccatcagagaagaggcacattgtcatgtaatgtttatcaatagtaataacaactagaatgtcttagtccattcagactgctataagaaaataccagaaagtgggtggtttataaacaacagaaatttctcagagttgtggaggctggaaagttcaagatcaaggtgccagcagatttggcgtctggtgaggacctgcttcatagataaccatcgttcgctataacttcataaggcagatggggcgaggcagctctctgggatctctttaataatggcactgattttatccccagagggtcctgcctcctaataccatcacactggggattggtttcaacatatgaatttgcagggggcacagacattcagtccatagtagatggcttttggttattggacaactccaacatttccagtgtgtgatcaacagtttatatgatgttccatttaaatctcactataatattattttacagactgaaattgtggttaactgtgagttgattgctgagtgtcaggagctgggctgcaaaccccagcctgataaatgtgaaaccccttgccttcctgggcaaactgttccaagccaggaactccttccccacattactgcccagtgccctttaggaaatgcttcctgcagtcacactcacgataatacctgactgtgaaaagaaggcaacccacagatctcaatgttcaacttttttgttgttgcaggaagagaagttaaacttctagagaaacctaacagacaatatccacaacaggtaagctattttatctttccatgctttggtgagaaaatctattctcttcactttctgttaaattttctatcatttggtcttctgctacagtttttattacctaaaaccttaaagccagtagacacagaagtccccaaagtctccttctttctgactcactcaggtttgagtagaattgctgtttcctttttacgtttgttttttggacatacaattctaaaacgagtgtgataatgcatggttcaaccaagtctccacactgaaaagatttccagttaatctatccccccgtccccaggcaatttcaagcttctcccgtaatgtccatgcctcagaacagtggctctcagcgtgtggtcccgggacctacggcatcagcctcacctgggtacttgttagaaattcagtttctccctggaagaaaacctaggcattaccattcaggacataggtatgggcaaggacttcatgtctaaaacaccaaaagcaatggcaacaaaagatgaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaccaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaatcacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaagatgagttcatgccctttgtagggacatggatgaaattggaaatcatcattctcagtaaactatcgcaagaacaaaaaaccaaacaccgcatattctcactcatagatgggaattgaacaatgagaacacatggacacaggaaggggaacatcacactctggggactgttgtggggtggggggagggggaagggatagcattaggagatatacctaatgctaaatgacaagttaatgggtgcagcacaccagcatggcacatgtatacatatgtaactaacctgcacattgtgcacatgtaccctaaaacttaaagtataataataataagataaaataaaataaattcagtttctcaggccccatcccagacccactaaatcagagggtccaggataacgactagtcctcgagatgattccagtatactctcctgtttaggacccaggtactgtgaatacagaccttccttctctttatttctctctgagtctccttcccaagccctttaccatttccatctttgtccgaacttgcattataatcttctatatatttttactccagtggaaccagcctggtcccctcactctgtgtctcctgaaagtggtgcatgcattattcttgttcccctttgcaaattctagatggtcaagctgcctcctatctgcaaaccttatcttcctttaaggttcatgccattggcctattctgtccttttccctacttgttgcctttatctggggacttcccagtggctctagatcattcaataccataggcccaaagcctttctgactttctgcactctagtcatcctcacttccactacatttcactttccatggccacatcctggaccatgtccttcattgtagacactaatatgccaatgccaccatctcttatggctccaaattctcatgctcaaggatgccaggtcactggtcttgcttttgttccccctaacctcattaggatcctcaccctgcaggactctttcttcttccttagccaacctcttggccacacagccctaaccttttagtgcaggctccaggtccattgcttcagccatgcttgccagcactctcaagacccaagccctgttgccttatacctcaacctgggaccagggtagtaacccacattctataggcctttacctggattgccgggcactgctgggagagggaaagaatgccagaactacatgcattggcatcactcagatttttggtggccagctgaggccaaccctcagcactgctcagctgcctttcagtcgttgctcttcccctccaccacacaccattccaaaccttgtcactttgagctttcacatctagccctttcagcagacaccttgcccctacatcaagaaactcacagcttacagtcttccagcttccctccctgcatctagaactgtctccacttaaaatcacccttgcctctttccctctaggctccaaaggaaaagtgtatatctgtacatctttctaaggtgtatttcttcattagtgatcttgacttgatcctagattttcccccattgtttctactattctcagtttctttcaactatctttttcctccttggcttataaaaggtatttatctttcacctgctacgaaaccatcctataatcctatatctttgttcactgtgactgttcccttcatcttttccatctcagccaagctccctaagagttctctctcctccttttcatatgccccatgcattccttaacctgctgcagcccagcatgcacctccactgctctacaaccttcctgcatttcccaccaacaacctccttgatatgaaattcaggtgcactgttccatcctttccttatctctgaggcacctgacactctttgatggaagactgtctcctctcctgcttcttgataataaagcccaattccctccttcctctctgagcattcttcccaatcctccttatatgctcatcctcctctgcctaagagcaaacaagcagagttaagacttgcaggcaactcgcaagccccaccctcatgagttgaatagttgagaaggcaggaaagacgtcaaaaaatgaattaaataaaactgtaagttgtgctaagaatgtaaagtgaaaggtgatatgaggtggaataacagggtttaaaactggctggtttagattgggtggggtgagaaggcaaaggaaatagtctatgacaaggtccttgagatcaggagcaaaacataaattttaaagacttgaaagaaggccaatgtggccagggaaagaaaggggggacaatacaccagaaagctgtgtatgagatagaaaagacttcatctattattgtataagtttcttattaattttaagtgagttactgcagtcgacaatcataattcactgtagttatgttctataaagtcacttcaaacaaggagttagtgaatactgcacaattgctctcaggggaaatatggggttaggttcctagaagcctctggtcacaatattttcatcaactgatcaatatataacttgttttatgtgtgtttcagttgttaaagcactttatttgcatatgtattgttaattcattaacattgagctcagggctaacagcactatgactcatttctgaacaaagcttatctaacacacacattttctctgtaaggcacatcacagcattcttgcacctaggaccactagacaacacgtcagcactatgcctggggctatttttaacagtgacatcaccaacaaaaagcacaaaatgcaaacaatgggtccatgagaagaaacccatttacagtatggcacagtgccatcttgtttgagctcagctagaaacataagcatctaatgactcaaaatattttgcccactctgcacatgtccaggaatggccacacaagcaccatgagtattgatttgggggttacaaattaacgttagtaagtcagtgaattcacaaatacagaatccacaaataatgagaaccaagtgtatatgtaaagcatatcgatgaacaccaggtacataagaaggaatatgtacatttgatattttaatcatcttcattattgcatgctactaaatatcctgacagcatgagatacctctgaaaagttttaggcaggggaagtgataatgatccagattcatggcctaaaaagatcgtgactcctttgtggcaaatatgttagccagagacactagcaggtataggtgatagtaaggcgatgttgcagtcagtaatccaggtacaaaagagatgatgctgtttgaggacagggcagtgggagtgcacatagttctcctggaatgtgctctggaaatctaccagaaccactgtctgcccacctttgcccacaagccttttctaatcttcctacggttactccggagctccttgtcctatatagcatattatatgacatatttgaatctagtacttatgacactatattagtcatgtatctatatacttgtctcctttcctggacagtaaactctttctacatccctggaatcaagttcggtacttggcacataataggtgctcaggaaatatctgttgcctgaatggttggtgagtcatttaacaaacagcagagatcttctacctcttagtgtcttagcaattagcagagtgtcttacccctagtaggggggtgtttaaggcctctaaaccgtgctcagtctttccaagtgcaaaacctatttttactgtactttaaaggaatattgggttccaactctgcacacgtaggttcatctacaattaggggacaaattgtaggttttttcttgtcttccgaccagttcttgcttccagtcttgagtccggaaaaacatttataaaataaaatagttgggtgggataacttctaagattctttcaaatcagagccctatatcactctgctaaggctaccataacaaaatactctagactgggtggcttaaacaaaagaaatttattttctcagagtcctggaggccgggaggtccaagatcaagaagtcggcaaattcgattcccgggagagctctttccagcttgcagatgccgccttctcactgtgtcctcacgtgccctctcctcagtgtgctctggacccaccagcaccattcgctttcgctcacaagccttttctaatcttcccgaggttgctcaggagggagtgctctctctcctcttaaggccaccaatcctcttatgttaggaccccaccctgatgacctcatttaaccttaattacctccagaaagccctatctctaattacactcacaatgagttagggtttcaacatgtgaatttgggggaagacacaattcagtccacagcgggtactgtaagactctgggaattaccctgaactagtttattccaagcaggtggccctgagctgtgcttcctttaaaatctatttgtagccttaccagactatattatataaactcctctccacatggccacctctaaaacttcctcagcatttttagaacttaattttgtccaaatgcttcaagtttcttccagatgtctgccatctcccagatacagctacttagcaaaatcagagacattccctgtcatggagacacggcccagttcccatgtggttccagggaagatttggtcaaaacattgcccatttctacacagtgtctaaatggaactagcacccaatggttaaagaatattctcagccagggacagtggctcacctctgtaatcccagcgttttgggaggctgggacgggtggatcaccggagatcaggaggtcgagacccgcctggccaacatagtgaaaccctgtctctactaaaaatacaaaaaattagctgggcgtggtggcaggcacctgtaatcccagctattcaggaggctgaggcaggagaatcacttggacccgggagtcggaggttgcagtgagccaagatggcaccactgcactccagcctgggtgacaagagtgagactctgtctcaaaaaaaaaaaaaaaagaaagaaaaaaaaccgaatattctcgcagacaattgccatgaacatgcaaacggccaacatttcctaagcacctactatttgcaagacacatattgccagccctgtcacatgcttaagtcatgtgatcctcataggaccctgaccagtacttctggtaatgcagccataaaaatgaaagttaccatgcactgatgccaggggtgtctgacttttttatttatttattttttttgagatggagtctcactcttactgcccaggctgcagtgcagtggcgcgatcttggctcactgtaacctccgcctcttggattcaagtgattctcctgcctcagcctcccaagtagctgagattacaggtgtctgccaccatgaccagctattttttgtatttttagtagagatggggtttcaccaagttggccaggctggtctcgaactcctgacctcaggtgatccacctgcctcggcctcccaaagtgctgggattaaaggtgcgagccactgtgcccagcccggtgtctgacatttttcagcagatcctttagtaatgattgatgctgagcttgttagaaacacaggctgtcaggccccactcagagccaggtggattcctcatgacccagtgccctgtgctcctatctgtctacaagattccaccccgtacacacacacacgtacacacacacacacagacacacacactagtctttattcattaacaaactacatcttgtctgctccaaacaggagcctacttccaggaatttacagtccagagaatagggacatagcttctcaaacttttcccttaaactgtccccacgagggtacaggaggatctgggaggctggggagtgtggagaggatgaccacaagctactggcagaacttgacatctctgtgtgccttccgtttcattctagtcattcacacaaatgttgccttttcacccatgatattctgagttaattttatataacaaataatgggcttctccccccaaaaccttcgcatggggccatatttattttgtggcttacctttccctcccagctcatggccatgtatcctcatgtagaagggggggctctgagattggctcacaacacgggcagcctctggatctgggagaagtgcaaggtcagccatggaggaggagcagcaccgggtctaatctgggggaaggaacaggacccccttgactccacagacaccttcctcccccaggctcttccacagagttattgtccaaatgtacagtgggcagagaccaacccagatggagttctgatgtgcagtgattgtgtgaagaggcctctgtagaatttcaggagccttttgaccccaccattgcttggccagaccagaataaacccaatgtctagccagtgctagaggaagccctggtctcatcaggcttaaaggtgacagtaactgtgatggttaatattgagtgtcaacttgatgggattgaaggatgcaaagtgttggtcctgggtgtgtctgtgagggtgctgccaaaggagattaacatttgagtcagtgggctggggaaggcagacccacccttaatctgggtaggcaccatttaatcagctcccagcgaatataaagcaggcagaaaaacgtcaaaaggtgagactagcctagcctcccagcctacatccttctcccgtgctggacacttcctgcctcaaacatcggactccacgttcttcagttttgggactcggactggctctccttgctcctcagcttgcagatgagctattgtgggaccttgtgattgtgtgagttaacacttaatattacctcccctttacatatatgtctatcctgttagttctgtccctctggagaaccctgactaatacagtaaccatctaaaataccacatcacctacttcataaccttgccgcatagcacaacacctacactacttgggccataatttttgtttctttttttgttcttttttttttattttatttttttttgctttttgagacacagtcttactccatcacccaggctggagtgcagtggcctgatcttggctcactgccacctccacctcccgggttcaagtaattctcccacctcagcttcctgagtagctgcgattacaggcgcacatcaccacacctggctaatttttgcattttcagaagagataaggtttcaccatgttggccaggctggtctcgaactcccgacctcaagtgacccacccatatcggcctcccaaagtgctgggcttataggcacccaaaattcttgtttctgaggctttttattttattttttgagacagagccttgctccattggccaggctggagtgcaatggcacaatcttggctcactgcaacctctgcctcctgggttcaagtgattctcctgcctcagcctcccaagtagttggactacaggtgcaccaccacacccagctaatatttgtatttttagtagagatagggttccaccatgttgggtcaggctgctctagaactcctgacctcaagtgatccgcccaccttggcctcccaaagtgctgggattacaggtgtgagccaccgcgcctggtcctgaggcctttcttgtaccaagtccttctcttgagatgagtaaaataaccgctatatcctgccatctgctggtgaattgatgcaactgcacctataaaattcagcccaaatctagagaatccagttctctcttgcaaaagctattggagcacaaactgcttcttgcataatccagcggacaaaaaaaaataaaataaaataaaataaaataaacttactaggatggatgccagaaatattatagtaataaaaacaataacaacattaataataccttcactatcctactttcaacttttacaaccttgggcaagcaagttatataacctcccatttagttatctataaaatactggttcccaccttaaagggttgttttaaagttgaaatgagttaatacatgaaagatgaaagtccccaaaacagtccttggcacatagaaaacactcagtggctaactgcttattgtgattaagtactggctgtatgccagacattatagcaagcgctatgcatacttatcttagtgttcaaaacaatcctcataaactgtaactatcatcattcgcgtgttgcagattaggccactgaaactcacggaggggaagaaacttggctagaagtcacaaagctagtaagcagtggaggtggaattgctgactactctgatcctaagtcactcgcttaaccactctgctgaactgctggtgtggtgtgatcaatcttcctgaatgttcgtctaaatgccatccggcttcaccagaatcaatctctctctctctctttctctctcacacacacacacacgactatacgctctcccagggagcacccgggtgccatcatatccccagaacctagcacagtgcctggtgcataccaagacccagtggagccatcgtgaagtcagcgatgttgcacacagctgtgagcattcgtcacacacctgtcttaaggatagcaggctaattactagatggggggaaaaaatagtatcagatcttgaataaagggccacatgaaatgtttttcaatctatgaaaatgtctgtgatatgctatcgtaaagactacaggagggacaaaaggagtgacatcatcactatgttgtaataacaacaaaaaaaaccacattgaatgtgtttccacattcaacatggatatcaaagatcctgtgaacccagcagcaagaaagtcctaggaccaggccctggcctgttcctcagcattcctacagtggaagcacctctcaggtgcacagggccggcaaggccagccttggtaaaggctagagaggcagcccttctagtggtatgattccagagggttcagggccacctgtcactgagaaacaccaatttcaacccagacattctaccctcagaggctgatttctttggctcctgggaacttatttttttacatagttttctttaaaatgcaggaacaccaggaggcccagggttgccaccagtgctctgaaaaccactctgccctcctgcctggcagcatgcacctctcagcccattcccagtggagaaggggggtcactttctccatcaggagtctccctggtctgagagcctcgtccctctcagggactttgctgttacacacattctgtcccaatctcacagttcctcctggcagaggctgaagaggcatttccaaaagagctgcagagttcagggaataagacagagaacttggccttttatcattcagtcaagatcatggcctggggtgagtgtggacgtaggacccagagggcagtattgcgaagagctagttcacaaaccactgggcgtggtgccccacgtgcagcacggaagtactgaagcatgccttcagcataattctcaggatttgatgtgataacaacaaggaaatcaagtcaatgagttgaagttccccttttttcccactttatcgtttagattgttaaatttcaaagagagctttgattcacaaactcgttttgcagataaagaaactgaggactcaagagattacagcctgggcaacaagacaaaatcccatctctaccaaaaaaattaataaataaaaatagctggacacggtggcgtgtgcatgtagttgcagctactcaggaggctgaggtgggaggattgcttgagcctgggaggcagaggttgcagtgagccgagatgatgccactgtgctccagcctgggtgacagagtgagaccctgtctcaaaaaaaaagggggggagagattaaacaacttcaccatgtccatgccattggtgatggcgttatggctaggaggtaagaagtgaatttctttatttttattttattttattttattttgagatggagttttgctcttgttgcccaggctggagtgcaatggcaagatctcggctcactgcaacctccgcctcccaggttcaagcaattctcctgcctcagcctcttgagtagctgagattacaagcacctgccaccacgcccagctaattttttgtattttcagtagagatggggtttcaccatgttagccaggctggtcttgaactcctgacttcaggtgatctgcctgcttcggcctcccaaagcgctggggttacaggtgtgagccaccacgcccggccccgaggaggtggatttcttatacctgggcacagactttgcctggctaagttcacccaaacaccatatagcttaattagtttgaggagtaaaactccagtgataattaggactgtcattttgatagcagatttttcagaagtattctacaaaacatgagatctgttggttgttaataagtttgttatgagaaaaaaagttctgtagcccaataatgtagggaaataatcgggttaaacagagtgaaacagttccttctcataaccatgaatttcttcatctttaatttctgttgttcccaaacctgttttgaccagggagccttttccagggagaaaacccatgagcacttccctgcacacaaatatcccgtcaaagccagcgctagaccatgctaacacttctatcccagcacactggctattgagaatgcatgaaatggactatttgatggtgctgataacaaaagtctgcatataatccttttttttttttttttttgagacggagtctcgctctgtcgccccggctggagtacagtggcgccatctcggctcactgcaagctccgcctcccaggttcacgccattctcctgcctcagcctcccgagtagctgggactacaggcgcccgccaccacgcctggctaatttttttttttttttttttttttttgtatttttagtagagacagagtttcaccgtgttagccaggatggtctcgatctcctgaccttttgagccgccgacctcggcctcccaaagtgctgggattacaggcatgagccaccgcgcccggctgtctgcatataatctttcaagttctctaaaataacagaagcttagcctctgtaggagaaaagtaaacacatcagaaaaatttgtcccgtgagttttcaaagactgcccaaaagagtaggaaatgtttctgccaaaaaaaaaaaaaaaaaaagattgagctgtcaaagagtttatcttctagtcctttttcaactatagattcattactgtctataatgttgggcaagcagtctctagtttcttctataaaggcagcacagctcctggtagttatttttattcattcttcttgggtcaggacctcagtccctagtagcggctcactaaatatttgtctacttcgccttctggccaggttatgtgaaatctcaagctgtgttttctaaacattagcaaattgttggaaatttacatgttccattctattgtatctcctcccttccaaatactccaacttctataaacgcaaaccacctcccagcagccactttaaaagtttgttgaatagaacccttggagccggacgtccttgacccttggaattgcataatagaggttttgctgtctcccaagatgggaagggggaacaacagtctctcccatttctccgagctcctgcctccggcttgtagtttggaccactgggtagtatgagatttgattgtggaaaagggtatagaccctctgttagaatagtttatcatatctcatacccatcatgccttcattcccacgtgtcattcagcgccattccttcatttaaatagtaagaatgaagtgccccatacaagctagatgctggttggattaggcattgcctgtggggagctcatgtgtagtagggaaggcagacagccaacaagcaccaaagtccccctctaagatgcaacaacagcctgaagacaggaaccataccctttatttgcctctagagttctcatcctgggactatatatggtcttcagtatatacacaggatgatgtgtaggttggtagacttttgatgagctgccttccaagatctctctccatggtctaatttatagagactattatccttttttttttttttttttttttttttgagacagacctcactctatcatccaggctggagtgcagtggcacgatcttggctcactgcaacctccacctcccgggttcaaacgattctcctgcctcaccctcccgagtggctgggattacaggtgcctgccaccgtgcccagctaatttttgtatttttatttttattttttgagacagagtctcgctctgtcgcccaggctggagtgcaatggcgtgatctcagctcactgcaagctccacctcccaggttcacaccattctcctgcctcagcctcccaagtagctgggactacaaatgcccgccaccacgcctggctaattttttgtatttttagtagagacggggtttcaccgtgttagccaggatggtctcgatctcctgacctcgtgatctgcccgcctcagcctcccaaattttgtatttttagtagaaacagggtttcaccatgttggccagactggtctcgaacttctgacctcaagcgatcctcccacctcggcctcccaaagtgctgggattactgacgtgagccgccacacacagccatatagggaatatcttaataacatggatttcctggaggtgtcaagtcccagcccaggttgtgacaggcagagtaagaactgaccttagattcacacgtttgtttttaacttcacaccttttttttttttttctttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttttttagtagagatggggtttcaccgttttagccgggatggtctcgatctcctgacctcgtgatccgcccgcctcggcctcccaaagtgctgggattacaggcgtgagccaacgtgcccggccacacctttttagaacattttattttgacattatttcagactaacagaaaagttgcaagaaaaatgcaaagaatccccataaatcctctacccagagtccctaaacatgaacatctaccacatttgctttgttgttctctctgtctttatatacacacaattttttttctgaatcattttaagcagttatataaaccatggtcctttagctctcaaatcagtttgattatcctctatccaaaatgcttgagaacagaaatgttttagagtttggatttttttaaaattttggaatatttgcatgtatatcatgaaatatcttaggaatgggaactgagtctaaatatgacattcaaatgtttcatatataccttttacacatacctgaagataattttatatttttaataatttgtgcatgaaacaaaatttttacttcgttttcactgtggcctgtcacatgaagtcaagtgtggtatcatgtaggtgctccaaaagtttcagaaatgggagcattttggattttggatttttggatttcagatgctcaacttttactttactgtgtatttcctaaaaacaagggcattctctttttttctgccttcttcccaacattgtattgtattttcaaacatatagcaaagttgaaagaattttgtagtaaatttctgtatacccaccaccaatccatcttatattttgctgcatttcaaagtaagttgtggacctcatgtatttcccttctctgctttcacttaagcatgtatatcattaatgagaattctgtacgtgtttgcattttttgaaatgactttcattacaaaagtaatgtgttcattgtagaaaattggtaattgcagatttaaaaatctacaaatctatcagttagtagtcatttgtaccagatattgtgctatgtattttatcaacatcatctctagtcatcctttcacaaaccctaagaagaagcattatccccattttacagacaaggactctgtgagcaagttgctgcagttcccacagtggcagaatcaggatatgcatccaagtctgtcccatcccctgactctcagctgcatgccatcctgctagccttgtgtctactccaccccactctgagataaccactgttaacccttctctctcaattcttttccaggtgtgtagatttccacaaaactgtgattatattatacaagtcattttgtaactggcttttttgcacatatgcaaacctctttctccagcaccttgttaatggctgcagggtattctgttgagtaaagataccatatttaagagctaccttattgttatttatttttcaagttttcactattatgaaatcttcttgcatactactaattttatccttagggtcacaagtagaattgctgagtcagagattatgcatagtttccactgttaatacagattctcaaatttgctttcaacatctcctaccagtagtaaatgactagcagatttccctacatcctacactgacatcaagtatacattttaacaactcatttttatctgggtgcagtggctcatgcctataattccagcaccttgggaggccaaggtgggtggatcacgaggtcaggagttcaagaccagcctggccaagatggtgaaaccccatctctactaaaaacacaaaaatttgctgggtgtggtggcacgtgcctgtaatcccagctactcaggaggctgagacaggagaatcgcttgaacctgggaggcggaggtagcagtgagccaagatcatgccactatactccagcctgggtgacagagcaagactccatctcaaaaaaaaaaaagaaaaaactcatttctagttagataagcaaaaacatgtatgttttgtttagcatacctttgattgttaatcaagttgaacatattttcacatataaggctttccctttcatatactacttgttcaggtccacacggttctttttttaagttggtctcttgaataattccaacccatttcacattaaagccaatgttaagagtgaaatttttatttttcaagcagattttacttcatttatttttattttaagtttttaaaattatttttaatttttgtgggtacatggtatatatatttatggggtatgtgaaatattttgatacaggcttgcaatgcataataatcatatccaggtaaatgggatacacattgcctcaagcatttatcctttgtgttataaacaaacaagtgatattctttaattatttttaaatgtacaattaaatacttattgactgtagtcacctgttaagctatcaaataccaggccttattctttctttgtaacttttgctttgcccccattagccatccccacttctctttcacccccacccccaactatccttaacagcttctggtaaccatctatctactctctatctcctgaagttcaattgttttaatttttggctcccacagataagtgagaacatgagaaatttgtctttctgtgcctggcttatttcacttaacataacaacctcctgttctatccatgttgttgcaaagtaaaggagctcattctttttcatggctgaatagttctccattgtgagaactctataccacattttctttattcattcttctgttgcttccaaatcttggctattgtcaatagtgctgcaataaacatgggagtgcaggtatctcttcaatacagtgatttcctttctcatggatatatactcagcaatgggattgctggatcatatggtagctctgtttttagtttctgagaaacctcaaaactattctccatagtggttgtactaatttacattcccaccaactgtgtatgagagttctcttctccacatcctcaccagtatttgttgttgcgcatcttttggataaaagccattctaacagggttgaaatgatatctcattgtagttttgatgtgcatttctctgatgatcattgatgttgagcaccttttcctatactgtttgccatttgtatgtcttcttttgagaaatatctattcagatattttgcccatttttaattggattcttagattttttttttcctgtagagttgtttaagctccttacatattttggttattaatctcttgtcagatggatagtttgcaaatgttctctcccattctgtgggttgtctcttcactccgttgattgttttctttgctgtgcagaagctttttaacttgatgtgatctttgttgtccattgttgctttgggtgcctttgtttcttgggtattactcaataaatctttaatcagtccaatgtcctggagactttcccttgtcttcttgtagtagtttcatagtgtgaggtcttagatttatgtctttaatccattttgacttgatttttatatacagcaagagagagggatccagtttcattcttctgcatatgaatatctagttttcccagcaccatttactgaggaaactgtcctttccccagtgtatgttcttggttcctttgttgaaaatgagaacactataagtgtattgatttgtttctgacttctgtcttctattggtctatatgtctatgtttttatgccaaaaccatgctgtaccgattactatatctctgtagtgtaatttaaagtcaggtaatgtgattcttccattttgtttttttcgctcaggatggctttggctagtctgagtcttttgtggttccacatacattttagaattgttttttctatttctgtgaagaaatgttgatagagattgcatgggatctacagattgcgttgggtagtatggacattttaacgatattgattcttccaatccataatcatgaaatatctttctaatttttgtgtcctttttaatttctttcaccaacattttatagtcttcatagtagagatctttcacttttttggttaattgctaggtatttaattttatttgtatctattagaaatgtgatttttttcttgatttcttttttggattgttcactcttggcatatagaaatgctacaggtttttgtatgttgattttgtatcctgtgactttacttaatttgcttatcagttctaatagttctttggtggagtctttagatttccccaaatataaggttgtctcatcagcagacaaaggtaatttgacttcttcctttccaatttgcatgccccttatttctttatgttgtctgattgctctagctaggacttctagtactatgttggataactgtgatgaaaatgggcatccttatcatgttttagatttagagaaaaggctttcagtttttccccattcagtatgatactagctatggatctgtcatatatggcttttattatgtcgaggtatgttccctactatacccagtgtttttagggtttttatgaagggatgttgaactttatcaaatgccttttcagcatcagttgaaatgatcatatggtttttgctcttcattctgttgatatgatatatcacattgatttgcatatgttgaaccatccttccatccctgggataaatcccacttggtcaacttggtcataatgaatgatctttttaatgtgttgttgaatttggtttgctagtattttatttaggatttttgcattgacactcatcagggatattggcctgtagttttcttttttttgatgtgtctttgtctggttttggtatcagggtaatactagcctcatagaatgagtttgaaaatattccctcctcctctatttttgagaagagtttgagtaggattggtattagttcttctttaaatatttggtagaattcagcagtgaagctgtcaggtcccaagtttttctttgctgggagactttattacaactttgatcttgttattggtcagttcaaattttggatttcttcatcttcaatcttgataggtggtatgtgtctagtaatttatccctgttttctagattttccagtttattgacatataattgttcatagtagccactaatgatttattgaatttctgcagtatcagtcgtaatgtcttccttttcatctgattttatttatttggatcttctctcttttttcttagtctggctaaaggtttgccagttttgttatcttttcaaaaaaaaccaatcttttgttgatcttttgtattgttttcttcatttcaacttcatttctgctgtgatctttattatttcttttcttctgggtttggtttactgttgcttctctagttctttaaagtgcattttaggttatttattccaagtttttctttgtttatgtaggcctgtatagggataaacttccctctaagtactgcttttgctggatcccatagattttggtctcgtgtttccatgatcatgtgtttcaagaatttttttcagtttccttctgaatctcttcattgacccagtgtttatttaagagcttattgttgaatttccatatgttcatatcatttccaaaattcctcttggtattgatttctagttttactccattgtggtcagagaagatgtttgatatcatttcaatttttttgaatgttttaagacttgttttgtgacctaacatatggtctatccttgagaatagtccatgtgctgaggaaaagaatgtacattctacagcagttggatgaaatgttgtgtaaatatctattaggtccgtttgatctacagtacagttaagtgcaatgtttctttgctgatattctgtgtggaagatctgtccaatgctgaaagtggggtgttgaagtctccagctattgttgtattggggtctatccctctctttcgctccagtaatatttgctttatatatctgaatgctccagtgttgggcgcatatatatttacaattgttatatcctcttgctgaattgaacccttcatcattatgtaatgaccttctttgtctcatcttaaaggttttgtcttgaaatctattttgtctgacataagtatagttattcctgcccttttttggtttccattggcatggagcatctttttctatgtctttattttcagtctatgtgtgtctttataggtgaaatgtgtttctaataggcaacagatcattaggtcttttgaaaaatctattcagccactctatgtcttttgagtagacagcttagtccgtttacatttgatgttatgattaataagtaaggacttactcctgccattttatttgttttctggttgttttgtggtcttcctttccttcatttcttcttttctgtcttccttctaatgtaggtgatattctctggtgatataatttaatttcttgattttaatacttttctgtattcattgtatgtttttttaatttgaagttgccatgaggcctgcaaatactatcctaaaacccattattctggcctggtgcggtggcctgtaatcctagctctctgggagacagaggcaggtggatcacctgaagtcaggagtttgagaccagcctgaccaacatggtgaaaccccatctctactaaatacaaaaaaaattagcgaggcatggtggtgcacacctgtaatcccagctattcgggaggctgaggcaggagaattgcttgaacctgggaggcggaggttgcagtgagccgagattgcgccattgcactccagcctgggcaacagagcaaaactccgtctcaaaacataaataaataaataaccattattttaatttgataacaacttagcattgcttgcataaacaaaccaacaagaaaaaaaaccaaaaacaaaaaaacaaagattctaacttcatcccctcactttttaactttttgttgtatctatttacatattatcgtacagtctatgtcttgaaaaatttttgttattatttatgattggttcatcttttagtctttctattcaagagacatttacataccacagttacaatgttataatattctgtgtttatctgtttgcttatgattaccagtgagttttgtacctttagattatttctcattgctcattaacatccctttctttctgattgaagtactccctttagcatttcttgtaagatagaactggtgttgatgaaatctctcagcttctgtttgtctaggaaagtttacttcttcatgtttgaagactatttttgccacaaacactattccagtgtaaaagttattttccttcagcactttaaatatgttatgccactgacatgtcatatctctcctggactgtaagatttccactgaaaagtctgctgccagatgtattggagcttcattgtatgttatttgtttcttttctctgctgctttcaggatcctttctttatccttgacctttgggagtttgattactaattgccttgaggtagtcttctttgggttaaatctgcttggtgttctgtaaccttcttgtgcttggatattgatatatttctctaggtttgggaagttctctgttattatctctttgaataagctttctacccctatttttctacttctccttatggccaataactcttagatttgcccttttgaggctattttctagatcttgtaggtgtgcatcattgttttttattctttttttcttctgtgtcctctgaatatatttttaaatagcatgtcttcaaggtcactaattctttattctgtttgattaattctgctgttaagagactctgatgcattcttcagtatgtcacttgtatttttcaactccagaatttctgcttgattattttgtttcaatctctttgttaaatttatctgatagaattttgaattccttctctgtggtatcttgaatttctttgagtttcctcaatacagctattttaagttttctgtcagaaaagtcatatatctctgtttctctaggattggtccctggagctttagttagttctttcggtgaggtcattttttttttttttttggatggtcttcatgtttgtggatgctcactggtgtctgggcattgaacaattaggtattcctcatagtctttccagtttgggcttgtttgtacctgttcttgggaaggcttttcaggtattcgaagggacttgtgtgttgtgatctgagccatatctacattagaggcaccccaagcccagtaatgctatggttcttgcagactcatagaggtatcaccttggtggtcttggataagatctgaaagagttcactggattaccgggcagactcttgttccccaaacaaaagtttctctctctgtactgagccacctgaagctggggatagggtgacacaagcacccttgtggccatgatcactaggactgtgctgggtcagacctgaagccaacacagcactggatcttacccagggccctctgtaaccactagctagctagctccaatgtttgctcaaggccctaaggctctacaatcaacaggtgcaaagccagccaggcttgtgtccttcccttcagggtgacaagataccccaggccctaagtgggagctagggactgaagtcaaaatccttagagatctacctggtgctctattctactggggctgagctgtcactcaaaccataagacaaggccatttccattcttccctccccttttcccaggcaaaggatcctcttcctatcaccattactaccacaggcccacagagagtattgccaggctactgccgatgttcacttaaggcccaagggctcctcagacagtttatagtaagttctgccaggcctaggacacatccttcagggcagtggacttgcctgtggtcaagtgcaaatccagaaatgccatccaagagccaaggccttgaattagggactccaagagctcgcttggtgctctaccccactgtggctgagctggtacctaaagtgcaagacaaagtccactttacttttccctctgcttttctcaagtagaagtagtctctccccatagccaccacagctaggaatgtgctgggtctcacctgaaaccagcacatctcagagtctcacccaaggcccatagcgtactacctgggtattcctgctggttattcagggcccaagggctctccactcagcaggtgatgggtcttgccaggacttggtccttcctttcaaggaagtgcagtcccttctggcccagggtgtgtctataaatgtcatctaggagctggggcctggaatgggggcctcatgactctgcctggtgccctatgctaatgtggctgagctggtatcctatggtgtaagacaaagtcctctttactcttccctgtcttttcctcaagcacaaggaaggggtcactttcattgctgtgagctgtgctgcctgggttttgggacacgtgacacaggttctcccttagccactctggtgtctcagtagatcaggtgcccccccaggtccactggctctggccccagcacagtactgatatcttgcctaggaaccacagttcttgtggcctaggctacccttcaagtgtattaggattgcagagcactttagtccatggtggtgcggcttgccaaaactcaagttccaacaactggaatatataatttccctctggctagatctggtccaaatgctccctctgtgtgtgggtaggctggggggtcgtggcttagctgatttcagcctggttttgctttctgctctgatagggcagcactgagttcaaacgcaaagtccccaaatcactgtactctccctcccccaaacacacagatgctctctccacgacatgcagccactgccaaggaatgggcagcggcagttcaagattgtctttcctactaccctctttagtgcctctttcagcaatatgaagttaaaaccaggtacactgattgtgtacctgatttttggttcttataaaggtgcttgttggtgtagatgatagttgttaaatttggtgttcctgtggggcaatgaagtgaacatcagtggaggcttctatctggccatcttgttctgcccttccccaagagcattctcttatataaccccagtacaatgttcaaaagcaggtaattcacatcaatttaatacgattacctaatctacagaccttattcagattttaccaattatgtcaataacgaccttttagcaagaaggacatgcagtgcatcggctgtcatgtctcttaaatctccttgaatttggaagcattcttctgtctttctttgctttttcataacattacattattttaagagtacaggccagttgctttgcagactatccctcgttgtttcaactcagagtatgctcttttgtcaggaaatcacagaagtgaggctaagttctcagtgcatcctatcaggagccacatgccattgattagtctcattatggcactattacctttgattacttggttaaggcgctgtatgccgggtttctccaacgtaaggataatattttgtccttaatcatatgggggggagctactttaagactaaatatcctgtcctcctcaaaatttcacccactagtcctaccatccattgatacttcttactgacatcaattattattatgatggctatcaaatggtttttctattattatgatggctatcaaatgatttttctagttccagtatttctcgtatgtttgttagctggtttcctacttgtaaggtagagtgttccctttccctttatgtatcttagtgtggactcataagtccttgttttattcaattggctacaaatgctgtagattagtaattattttaatattccagttgttccacatttggccagtaaaacttctacaagtggattcctgtgtccttttaaaatgtccctgtcattcttcaaagctatcactatttaaaggcagcttccagatgggttgagtcttttcctatatgcccttgacttcctaatgaatactcagttaatttctctgcctggctggagaactcctgggcttccctggacttcgcccttcccctacctccattgctaccctcccagcaaggaggcttcaccaatgactgacatggcattagcatggccttctttttttattgtttgtttgtttttgtttttgtttttttttttttgagacggaatctcgctctgtcgcccaggctggagtgcagtggtgcgatctcggctcactgcaagctccgcctcccaggttcacgccattctcctgcctcagcctcccgagtagctgggactacaggcgcccaccaccacgcccagctaatttttttttatttttagtggagacggggtttcaccgtattagccaggatggtctcgatctcctgacctcgtgatagcctggccttgtttaaacacaaaacagagtcagcccccaacacagggctgcagaagcaggcggcagcagcattgggtggacacagccatcctaatggtgtttgtttttcccctgtgtaaactaagaagtggttgtgaaggattttccctttgttgcctgttgcttttttatgctccaaagaggaagcaaattttgattttgctcagtaataaagggtacccaacaactgaattcttacctttaagctagctgttgccaaaagggaggcaaggaagacagctgatagactgctcattttgaacccaatcttacgtcaaaagagcatatttttttcattgctgtgtgtcacatgctagacccggagcatttccttgttgcccctgggcttaggagaagtccttgctaaatgcaagatgtagaagtgggagtgacatatgaaaaaagaaatgaattaaatttgatatgacacatcatataaggaagaataattgtagacacaggcatgcaggggttgggtgtgagtacattagtccccacccttttcgtcagcagtcacacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtatgggaccaggtctataggaaacccatgtggtgtgccctaatgggaggcaagccggggaggacccaaactggaaacctgattctgaaagaggaaaaccaccacaacatcctttgtaattgtgcagcttggaagaacagtatagatcctgtggttttcctggggaaggaggggagcctaaaagccgcaaatgatgtatatttccttcagaagcagggaaggggcagttttcgagtacggctgttaaatctcagcactcacttcattcggtgcaggctgctcctgtggtcttggctatagcagcagaaggcggggatggagggtgccccagggtcaatcttggtcagcctccgaggagctgggagtgcaaggtgtcactctggatgtgcctgcctgcttttcctcgccttcttgccctccttcgcctttcctccctcttttctttcctcctttctttcgccttcccctgtacacctcttgaattcaccatcataaagttgacctgagatgtttcaatgagtaatgttttatgattgcttcagttacattattacaatccagtctgccttccttgtttctcaaacagttctaagctcttttctccttttctttgacttgtttttttttttttttttactacctatcctcctgactagttgttgttgtttgttggttggtttgcttttaaagagtccaggataaacaaagtattgcaggcatgaaaagggtcaggatttcagagcgaattgtggagggggagggtcaggaggggaggggagaggaggggagaggagaggggagggtggaggagaggtattgagggaggggaggggagaggagaggtattgagggaggggaggggagaggagaggtattgagggaggggaggggagaggagaggtgttgagggagaggaggggagatcagaggtgttgagggagaggaggggagaggagaggtgttgagggaggggaggggagaggagaggtgttgagggaggggaggggagaggagaggtgttgagggaggggagggtagaggagaggtattgagggaggggaggggagaggagaggtgttgagggaggggagggtagaggagaggtattgagggaggggaggggagaggagaaatgttgagggaggggaggggagaggagaggtgttgaggaaggagaggggagaggagaggtgttgagggaggggaggggagaggagaggtgttgaggaaggagaggggtgaggagaggtgttgagggaggggaggaggtgcacgtgcttcttctcgcctgtcctatttatccagctcatctatgaattatcagcagaaaaggaaagtaaaggaggagtagaggctgggaataaaatcctgggctttagaaatggggtagtttaagagtattctgaaaggtacaatgttacacatgtgtacacagttccatagcaaaagcgatttttctgtctacgggactgttgttgtacttggggttttctatctttcaattggtgtcacagttgatagaaatataccatgtagcccttattccagaaacaagtcctacttgacattgttaatactcttgtttgtatgcataggttctggcaactagattatatctttcttggatactagacctccatctttttctttttggggggtgtgttttaatatgctgtatccaaatggggtggttaagacacccctggtctatgtttattatgaatgtttgctcatatgacccccagcaacactatatagtaggaatattattatccccatctacaggccaagtgactgaggcccaaagtcccacagtagcagggttttctgtctcctgagcccaccctcataacacctgggcgacacggctggcacaaactggaaatgtcttgattggttgcagacacacaacaggttcactgatagtgctctcgtttttaatccatagccattaaatcattcattcattccacatttattgactgcctgctctgtaccaggtgctgtcctaagtgctgagaattagacttgaagaagggtggagcacggtaaggaaagagggtggcaagagatgcacggctggtccgagggactcttctacattccatgagtcctcccaggaagagttggaaggacaaggggtttggtcctcaagcatgaagtgatttggggatgttactagttttctgtgctgctgcagcaaattactacgaacttagaggtttaaaaaaatggaagcagccgggcatggtggctcacgcctgtaatcccagcactttcagaggccaaggtggatggatcacctgaggtcaggagttcaagaccagcctggccagcatggtgaaacctcatctctactaaaaatataaaagttagctgggcgtgttggcaggcacctgtaatcccagctactggggaggctgaggcaggagaatcacttgaaccagggaggcagaggttgcagcgagccgagattgtgccattgcactccagcctgggcaacagagtgaggctctgtctcaaaaaaacaaacaaaacaaaacaaaacaatggaagtttattctctcccagttctagagaccagaagtctgaaattggtatcagtgggcttgatccaggggtgggtatcagggatcaaggtgtcaccggggccacactctttccagaggctccaggggtgaatctgttccttccctcttccagcttggggggctgccagtactcttggtttgtgacctccttgctccaatctctgcctttttggtcacattgcctcttcctcttctgtctataatcaaatgtccctccacctccttctcataagcatttatttaattgtatttagagtccacccagataaactaggcaaattgtaccatctgaaaatcctacacttaatcacatctgcaaatacctttaatttgggggctggggtggcatataaggtattatttataggttccagggattaggatgtggatatctttgggggccatttttcagcctaccatagggagttatttgtggattttatttttttaatgtaaatctagtcccttttaactaagcaaccaatctgtacttcttaaaaagcaccagtcatattcactgtggacaaaagcttatgaagcagcatccctggaaattcacctatgattgaaagaaggaaggagggacaacatgggagacagagacacagccagcaatgaatgatgtctctttctggtgcatgtgcttcatggagacagggagactggggatgcagattctgttttggcttgtctttttaaaggctgtaggcccgtcacagtggctcatgcctgtaatcccagacctttgagaggccaaggcaggcagatcacttgaggtcaggagtttgagaccagcatggccaacgtggcaaaaccctgtctctactaaaaatacaaagattagccaggcatggtggcacccgcctgtaaacccagctacttgggaggctgaggcaggagaatcgcttgaacctgggaggcagaggttgcagtgagccgagattgcgccactgcactccagcctgggcgacagagtgagactgtgtctcaaaaaaaaataataaataaaaataaaggctgtagatattagaaatgaataatatctaagagatgcttccatactcatttttaggatgttctgaggaaggaagaggccaacatggtcagttttatatgaagagaagattttgttccaaaggaaatgatggggaaaagcccagcttggggaggggtcagggaacagtgggcaagtgggaaatgagtccaccttctgccaggaagcccaagggggcatgtctttgagctgcaaaagaacaggtccacaaatcatagctgagattggcccagcggtaggaaaagcaacacagaatcaatttagtgtggttgaagcttgtgcgatgactcgggctatcacgctcctcagggcctgaatcatgggacacaatggatccgccagcttattccggcatcctttaactcttgaggagcaaatgccctggcaaggaatccgtcagaatctccttcccctcctgctgctgcgtgcagtgggccgtgccctggtgaggttcctgtgtcctctgtagaaggtaacagattagaaaagcagaagtcccttctctgtctagcatccttccaccttcttctcctcatctgcaaaatggggatgaaacacataaccccagggttgggagaaaggtctgacacagaggcaagtgtcagtgaacgtttgagaactctgaagcggtgatggaaatggggtattcctggtaaccagcaccctctctgacccacgtggtagttatccttttgccaaaatgtgtgactctcttaatacattttgagtctctagggaaaaaaaaaggcaaacttaattcctactaatatatcactcactgtgttctctaccttttacgctttcttttccaggtggtaacagaaaacaatccagatggggtgcaggtgctgtaaaataatacaaaggtaaagctggagaaatactacttctaaatggaggaatttgtgatgagcgtggggtcacttttaaagaccatgcgtgtattcagtgcatttatccagcttggggcatgatcaacattgccaacacattaagagtttggaattgttataatatcatttaaaagaacatgtgccctagatttttttaactttttttgctcacttctcaaagcatgttgggaacaccatcattttctgaggctgaatttggtctgggtttctgaggatgcctgaaatggcatcgctgaaaataaatcaccccaatcacatatgtgcttttaattttgtccacattgcatttcagaaaattgtgagtaacgtgaacataaacttctaactaagaaaaagggtaactgatgatcttgctttcttaacaaatatactgtctttttaatcatagttctattctagacctatatataaataagctgtattccactgtaatcatactgtgatgtttggctttattcaaaaactatgtattgtaagtatcattcctgtgactacagacttcatatttatcattttagtgactgcataatattccactgagaggatatactccttatggccctgttagtggacatttgttttatttgttttttattttaaaattctatgaaccactttgtattttacttcaccccttacccctccttcctccttttggctctcttcttaagagtatttcaggcagaaccttgtttatctttttcaagactgtctcgctctgtcatccaggctggagtgcaggggcgtgatctcagctcactgcagcctccgcctcccaggttcaagcgattctcctatctcagcctcccgagtagctgggattacaggtgcctaccacctcacccagctaatttttgtatttttagtaaagatggggtttcaccatgtcggtcaggctggtctcgaactcctgacctcaagtgatccacccgccttggccacccaaattgctgagattacaggcgtgagccaccaaacatttttataccaactatatctatttgatttagacatacttatctaggttgaaaagtaatcacagaaattaaattagcaggaatcgtagaaagaagcagggcctgtggtaaaaagcattaatgatggagcagacctgactggttttcattgtctttcctgaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcctggccaacatagtgaaaccctgtctctactaaaaatacaaaaaattatccgggcacggtggcgggcgcctgtaatcccagctacttgggaggctgaggcaaggagaatcacttgaacctgggaggtggaggttgcagtgagctgagatcgtgccactgcactccagcctgggtgacagtgcaagactccatctcaaaaaaaaaaaaaaaaaaaagagctaagctaggcacagtggctcatgtctgtaatctgagcactttggaaggctgaggtgagaggattgccagggccaggaattcgagaccaacctgggcaatttagcgagaccccatctctatgaaaaaaaaaaaaaaaaaaagagctagactacaaaattatactcaaggaagggaccgagctggtttgcagagccatagctttggctttctctctgtcaaacttgatgccataactaaatgtcctgatcttacctcaaagatgaacaagccctctctggatttcagccttctaattcactgaaacaaggacaaccattctaacgtaactcaatggagaatttaaaggcattaaggatgctcaaaactatctagaaaaaaataaacatggaagatgctttagtttggtgttttgtaacacagaattgaaatctgactgaacttcatttgatttccagctttgccatgtgaccttggacaagttatgtatccctttacccatctgtaaagtgagaagaataattgtatgtgcttgtaaaggttaaatgagatgatgtaagtgtttagcacagtgcttggcacactaggcactcaaaaatgatgttttactagttgaaaacaattcctttaacaaacatttttacatccccacaactgaaaactctaaaactgggaagtatgtataatgtcattatttgactttggcaattatttagtataaaacatgatttctgagccttccagcacctttaaggacggcacccttacaaatgcttaatgagcctatgggtttgtttggtactgtaatgacaagccatcgcaagtgacctctatatacagggtcactcagagcccttaaaaagataaagtcttggcattgttaattgcattagaggtatgtctccttttgtatttagtacaccaaatacttaatatttcagaatgcttattccttcaatgatttcctaagtgtatcagttgagattatgttcagttgtatgggacgagtgttttatacaaatagaggcttatttacctcttatgtaaaagaagtctggagttagtgatccagggtggtagagaatgtatcactggcccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaaccccactcactctctattaaggaccccacagaagtataattcatcccttccacattactctctttggtcaaaatctggtcacttggccacatctagctgcaagagagactaggaaatcgtcttgctagtggtgtgcgtggctttgccaaataaactcagaatgcagttactaagaaggggaaatggacaatgagtttcgaggcggtcagtttacagtctctgccacaggaggtctcaaaacccaaaagcctgggatacagctggtttcaaaagattggaagatcgtgtgtacattcagtgtgacaccaaaggggcttccacctttggtccgggggaaggaggactggacagctaccgctgctccaacttcccattgataactccaaaccggacgaaaagaagaaattcagacaaagaaggggtagggtaaggtatcagggcagacaagtctctttctcttacccagacacacactttcgcatttatatatgtatataattttacatcttagaacagctgcagagttcaccataactgacagctctgtagttttaaagattctcttttatgaataactgctttgaaaaggtcgacagatggccaatactttcaagagttctttaaaagtaattctggcccctttcatctttactccagtatccaggatcccccaaaggaaatgaaagtaaaaaatctttaggttgaaaagtaattccagcttttagccttatctaccaggttgtctaacagtgagctgtctgagcacgcttatgtgtgtagtgtcttctttctgcagcctagtgccacctcttgtcagaaaagtgatgttgaaaatagccaaccttttcaaacattgtggacaatatgaaagcacaatgcactctgattggaaggcactaactgtgattaggggcagacttcacagttccccatgaaccttaggcaattgcatcacgtggatatttaccatgttaaatcctgattttgaattaagattattttatgtatatattacatataggtttcttgagctaagaagttagatttaactttttactgggggaaaatgaactatcatataaatatgaaattaaattttttcccctcattgccaaagcagatgtagtgaatagttataactggaaaaaccagatacccaaaaaaacgaagagaattttaggtttcttacatagcacatgcccatctgtccatgctcagtaagtgctggccattcgtcattttcctccctctgccccgctctgtctctctgattctcttctcttcctacctctcccatccgtacctccaagcaggaggccttagaaagaatgaatgagacaccagatgcaagtgcaagtgcaaagatctcctgacttccctggtttggtcgtctgtgtgcaaccatgcagcagatagagcacagtcactactgcagcacaggatatagcctcctttcctggacttggacttaactcttcatcaagggcactgcttttcacacaaccaggctttatgacgaaaacgtagaaattaattgctttctggtcttgtttcattttttttctctagattaaacctcatgcatttttaaatcctctattttggagttggtgacaaacacagacaagctgacatctgtttttcatggtaaatcctttccctgttaactaatagaacaataagtcattcatttatagatttactaaatttgtaagtttctcatatgtatcaggttatacaaaccacacctaagtggtctgctaacttctgaagcactcccagccactttaagaaacattttatgcaagtcaatgtgttgatcgtagatgatgcttacctgcacatttagtcacttggagtcaactattagcaatttttttcaactgaaatatctgtactaaaaaaatgcgtttggcctgagatctaagttagtgtacggcacaaggggggaactcaatacatatttgttgattgaaagaatacataaaagaagtctggagttagtgatcttttcccggtctggttggggagatatcatgcaggtagccaggattgtgctggattgtgacatggtgtaataaaggtatacatggtgtaataaaggatgtgggagcacaaatccataggaatttgagagtttaggaattgtatttattattcaggcccttcactctcagactaccctgctctatttgaataatgaggcttgtggtggtctgtggaaaagtggacagagtagaatttgggcagctgctgaaggtttggtctctagaatgagtccacgttaccctaaggacggtaatcccaaattgagacaaaaactttaagaaaaccaatgtttggggccaagcaatggggagcttggccgacctcgttttttagtgattttgaactcaatctttaaaatcctggaagagaaggaaaaaaagggtgtatattcgtgtaatgacatccagatctcaccgttctcttggctcctagtgatgggggaaaaaaggtgcgcccagggttgacccttcagtaacacctgcagccatgcgtcatgacctccaggtgttcagaggccctgcccatgtgacacgtgcctggtacttcccatacatgtgcctctttaatcctaataaacctggggtgaaatccggctgtgcctcttgctcgctgtgtgaccttttgactttaagttccttaacgtttctgagcctcacttttctcatctgtgaaatggggatcattcctatttctaagaattgaaagcgcacattctcaaacttcagtgtgcccctgaggcatgtggtgtgcttgtttaaaaggcagatttctggacctacctctaggaattcagacttaggaggtcttgagtggggtcctggcatctacatcgtttttgtaagtaattctccgcacttggagaaacacataagactccagcagggattgccacaccttttttttatcttgcaccagttatcagtaaaaagtactgcacacacccttaatataagcacttttacaaccatactgtcttctaatatgttatatggtttacagtatttagcaatactaagatgaagtaacaacatatcagagcattaatatttttttcactcccctggggtatgtgaaacctactttggaaaccactggtttagaagatcaaatgaactagtatatataaaagctctctgtaaatagacaaaactgggcatatatatatatatatatatatatatatttttttttttttttttttttttttttttgagatggagattcattcttgttgcccaggctggagtgcaatggcacgatcttggctcactgcaacctctgcctcctgggttcaagcgattctcctgcctcagcctcccacgtagctggaattacaggcacgcgccaccacgcccagctaattctgtatttttactggagacagggttttgccatgttggtcaggctggtctcgaactccccacctcaggtgatctgcccaccttgacctcccaaagtgctgggattacaggcgtgagtcaccgcgcccagcccgggccaatatttttgaaagcacatagagcatacacatgagtgtggaccacgcacttataatataagcccacttgcaaatccagtcaacaccactgacctgcaactcttcctcctcacctgtgctgccctctgagccttgttcctaggagacttctgtatttactgcctttaagcattttggaatagttaatacagaactaagggaaaatatgacctagagaccaaaaggcagacaaagaattttacttatctccctaatcaaaactacacattccaaactaaaatgagtgaggcctttgaggaacaggctaattagaatacttgtttagtcagaatctggctactttgaaagcacaacaatgcaatttctcttgacataagttaccaacttaaaatcccacacaaaaaaatccatttctaggtccaactcattcttttccattctccaaaatattcctaaagctatggagaaaggtaaacctcagaatttacataaatcaggaagagttcacaggccacagaaggtccatagcctctactcatcagccgacgtgctgctctctctgtcttagatgttgatgcttagaaaggaaacaaaagctttaaattaccaatttctgaagacacaagatctaaggtccaaggttttcatggcatcagccataagccgggtgacaaaccatcaaggactgttgtggtttttaaattaaaatttacaggggctgggtgccgtggctcatgcctgtaatcccagcactttgggaggccgaggcaggcggatcacttgaggtcaggagttcaagaccagccgggccaaaatggcgaaaccctgtctctactaaaaataaaaaaattagccagggctggtggtgctcgcctgtaatcccagctacttgggaggctgaggcaggagaattgcttgaacccaggaggcagaggttgcagtgagctgagatcgtgctggtgcactccagcctacatatatatatacacatatatataaaatgatatgtaatatatatatatcataatatatatatatatataactcctcctatagctacttttctgcaaataactgcattagtcatgagttctttttgttggttttgttggttggctgcaaatgacagaaacccaaactagataacaaaagaatttccttgaatgttctgttctgggaaacaaagtgcaactctgtctcaaaaaaaaaaaaaaaaaaaaaaaaaaaaaaaagtttataggaagaaaatatatagagaaaaaatctgcaaagacattacttcaaaataatttgccaaatattaacgtagaaattgtattcagtaattaatttctgggagccaacaagttatgggttttggtattttgttgttgtttttagtatttttataggtatgactatagcttaacattttcagtactgctatgtgttaagcaccaaatgcagtcagccttgttctaagtactgcacgtgaatcatctcactgaagtctaccgtgacgccatgagctataggtatgattgtccccatttcacacatgggaaaatggaggctcaaacagctaaataactcatccagaatcacacaaccagacagtggcagaatctcaactgaacccagactgaacaacaaaccggtgcttttttttttgagatggagtctcgctctgtcacccaggctggagtgcagtggtgtgatctcagctcactataacctctgcctcccagcttcaagcgattctcctgtctcagcctcccgagtagctgggattacaagcgtgcaccaccatgcccagctagttttttgtattttagtagagacaaggtttcaccgtgttgcccaggctggtctcgaactcctgagctcaggcaatccacccacctcaccctcccaaagtgctaggattacaggcgtgagccaccgcgcctggcccaaacctgtgcttttaaaggtgacataatatgcctctctgtggcaacatccatgttgccattagacaaagataagggctgaatcaaaatgtgagacaacccaattttgtatatgtaaaattgtatgtattgtcaattgggattaaaagggggttttgttctggttctaaggaagattgtaataaagaatagaaaagttagtcaaggccttgtaaccataataggtctgctgcccaacgtgccgcaagtcaatagctgagacacggggttgccgcagagcaagaggtttaatgggagggccgctgaacgaggagatggaaggaaacctcaaatctgtctccctgaggagtttggggctaggcattttaaagggtttggagtaagcctaagtgtggtgatagttgattggtcgaagagtacagggtgaagtcatgggacagggtgatgaagaaactgtattctcatgctgatcccatttgtctgggtgggttggctgtcagctgtttcactggaatttgggggaaaacaccttaagcaattctaacaaaagctttatgattctaatgtcagaaatcctatctataggaacaatggggatgcacatggccaggatctagtgctactacaggacttttggtgacaaggaagtgggccaaagtacagcctgattaatgcttaatccagaattcttgttaaccctgtgaggacagcttcagctttatctgtaaaatctctgagactgtctactgtcaatggtatttttgcggcaatcgtaagaccatgaatttcctttccctacaaaggttgaggcagatccaggggccatatgtccccacccatgaaccacccctacatagcttaagattcctttcctcagtttcatcatctgtatagtggaggtgatggctaggcccctctctcggccataatgagatttaaatgagataaaaagtgcttagcacgtacccagcacaaagtaaacaataaatgttagatgtaattttgtccgagtacagtggctcacgcctgtaaacccagcactccgggaggccgaggcaggcgcatcacttgatgtcaggaattcaagaccagcctggccaacgtggcaaaaccctgtctctactaaaaatataaaaattagccaggcgtggtggtgcacacctgtaatcccagctactctggaggctgaggcaggagaattgctttaatccagggggcggaggttgcagtgagccaagattgcgccactgcactccagcctgggtgacagagcgagactccatctcaaaaaaaaaaaaaaaaaaaaaagttagatgtacttttattatccagcgaaggtcactggcccacttctatgagtaacactcaatgcttttttaaataactagatctttgttgctacccaccaaagctgtatgaatcacttctaataatactaatttctaaactgggtaagttctgttctacctacatcattaataatcgtctaaaggcaaaaatgcatcttgggggcacttcaattttagtgtatttttattctcattatcttcatcatttaacaattgtagaacacacgggaatttatcctttgaactttaagtcacattgcatttgaagtgaatatttatagcattaaaattgacctttcttttatctttcctcatgccccaaataagattttataaaataaaatgcatttttaatacaaaacagaaaccatggaagatttgggagggttgattggttattttggagaggttgtgtctggcttgggttttatttagtatggatttgtgcgtgtgtgtgtgtgtgtgtgtgtgtgtagtttttgtttgatttggtcaacactaatattcatctgtaataagtaaacccatatattttttcaatttgggtataatgttatgatttcaagagtattttgtctatgatttctcagctagattaacttaggaatgaaaataaattgagtta

SEQ ID NO: 1959 - DNA, 96009 bp, Homo sapiens
ccagaagtcttgagaaatcaaagggtttcttgtcagaagatctcatgacagtgaaaagaataaaaggatggaggcaaaaattgacctaattttctggccataaacatagaaaaatacttcacaatggtctataaaaacgtaattataaagatcattttcatacagctaaggaagttaaaaaaaaaaaaacccaacctcctatttcttgaattgtagcaattaagtcttgtcctaagactcaagttcgaacgctagttctgtcttagactactacttgaataaatgatgtaatttctcagagcttgtttcctcatttgtaaaacggagatagtacttgctagcactgttgtgtgaaggagggaaatataggtgtgaaagtactttttaaaaagtaaagtgccatgctcagcgtatgcacatgagggtttgagttgtgggttatggagagagttgtcaggtgatttaaataaattcttatttaaacaaacttatttaaataagggctagaatatacctagaacgtttaacatggaaatatatttacaaatagaaaacactttataaaatttcatcttggagtatgtaaattctttctaaaagttgatttactttaaaaattttgtctgaataattcataagtcaaaacaattttttaaaagaggacacatcagaagtctctcatgcctgtccctttcacctgggttcccttgtcttgctctctgccacagttttgcttcctttcctgtcaatattctcttatccaaatatgagaaaatatgactatgtaccctctgagttttatttgcaatatcattgtacaataaattcttatcacccttttcttgctcatcagtggccaagataataaattggtcagttacacagcaaatagcaggcctaggactcaagtccaggcttgctagtaccaaggtaccacatctactttgttttgctacgttgtgaactttctgtgaaatagggtaaatctttcagaaaactgtgtatacagctgtgttcttaaaaatatctgcctttcagattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctataaaaccaagtattcattttttattttttgccaaatcagagaacttactatctctctattgcattgctgaaaatcatggttactttgcttttctttcttactgttagtaagaattctcagctttcttggtggtctgagagcttattttaaaaatgctttggagccatacaactaaaagtttcttgggtagggcattttaaagatgttttctacctgataggcacattaaaatttatttatttattttgccaggaatactgtgttgagaggcacactaaaattggagaaccggtggtttagtttagaatatgactcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacagatttcagaattgtgttgctgggtagacgactatcttgcaactttaattgcctagttagctttcaactatatgagatccaatttccctaatatttgattaaggtgaagcttttttccctctatcagctcctacatttgtgtgtgtgcactcatgagcaataatcaggctgaataaacgagtaggacagaattcatactcacttgtacatggcagtgttcttaaattcaccaacactgtaccatagtagaagtcgtgtaaactggcaatagcacattttgaaatcctgtattattgatttttaggaaaaagcagcagagatttcaagcatgtattaaagttcgattagtattgtctattcaaactcaaaatgttattaggtactttctagttaaaagggtgaaactggtttatgtaccgaaagttgaggccttttcatcacaaatgctaatgagtacaaacactagctaagaactatggggaattaaataattatgaagtaaatcaggaccaaagcacatttcttctaataaccaaaccactgttttccctttctggtcttttgacatagaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacctttactaaggcctttgagctatgaaggaaattttatgaagttttttagctagcccagctgcctttcctcctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgcccagccaacaatgacacttttttctaagtcataaatcccagacaatgccattttaataaaatacatccaaatgaccctggaaaggaacagaaaatttaagtaatttctaaaatacataaagtaaaattagggctgggcaccatggctcacagctgtaatcccagcattttgggaggcaaaagccagaggaatgcttgagcacaggagtttgagaccagcctaggcaatatagtgagaccttgtttctaccttccccctacccccgccaaaaaaaaaaaaaaagggaaattagctgggcctggtgacatgtgcctgtcatcccagctactcaggaggctgagcccaagagatcaaggttgcagtgagttgtgattaccccaatgcactccagcctgggtgccagagtaagaccgcctcaaaaaaaaaaaaaaaaaaaaaagcagagaatagaagtgggagtctaaaacatacaggagaaaaacagttctaacagagacagcactgtaggaatttcctgaactcctgcaatttgccatggcataatttccctaaggaaaaaaaaatctagaactgtttggtgatcacatgcatggcagaattagtagaacaaagcctgaagcttctacaagtgcatcaaagaaagaaaagaaggaaaacaagacctaactctagcactgtcccctggcgagaattcactgtggaatgctctcagaaaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagcatctgagaaaaaccaaggccataaaagggagacaccattcctaacagaacactgtagaaagcagagaaaattatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaaaatcgggatacatggaagatagatacagaattccgtacatgcagtaacaacaattgcacaggagaacagactggaggaaacatacaaagaaataaaatacataacccagagataaaggaagactttgtcttctttcagaacaggtaggataaagagaactccaaaactactcagaaagaaaccaaacctgaaaatagattgcctgagaaaagggttgagaattggactagcatcagacttctcaattggatactacaccacattagaactctatcttcaaagttgtaatggaaacggaattctgtatccattcaaagagcaaaacagagatggaaaagcaaggacccacattttaccatgtgtggccactttctgaaagaatagtcaagggactatccaacaaaacataacaattctaagagatacaatgtattaaagaaggaaaaggaaataacttgatttaaataatttttgatacacaatgtaaaacaaggtattctggaacaaaaatcttagtgatttgattctatatgggaaatgttagcagggagggtgtgtgggtgggagggggcacacaggagcaagcaaatgagagagcagtgtttgttttgcacaggaaaaagagtaactctagatttgagctgttcagtagccattaaccactgtgactattacattaaatagaattaaacatttagttcctgctgggtatggtggctcacgcctataatcccagcactttgggaggccaagactggaggatcacttgatcctaggagtttgagaccagcctaggcaacatagtaagaccctatctatctcttaagaaaaaaattagctgggcatagtggcacacacctgtagtcccaactactcaggaggctgaggtgggaggatcacttgagcccaggatgttgaggctgcagtgagccatgatcatgccactgcactccagcttgggcaacagagggagattgtgtcaaaaaaaaaaaaaaaattcagttcccatgtcatagcaacacttcaagtgctcattagctgccatattggatggctctgatatagaacatttccagcattacagaaagttctattggccagcattgttctagacattgagaaacattattttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatctacgtaacctcaatctagcacgagcaacaggcagatttcgccatctttgttgtggtcaaggagtcttcttgggttcctgggttctttagtctcgaaatatataagacttttcgttcttcgctagtcttctgagctcgagatgaagcacagaaggctaaaacaatgagggacagcgttccagtagccctgccacagctctctcatcctctggtccgccctcactcaagatggctaccagcaagaatggtgcaatggcgtgacagctcggccctggttgccaaggagatgcgagtaccggaaatgcggaattcggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggtaagggagaacctgctcgcctcacctttgcctctggtcactcctctctcacgtaccgggggagcgactgttcgcagttctttcctcttggcagctctgggagacccttctcagtttgccgggagccacctgcgaagctccccctcgcttcacctaagcgtcccatccaagaggaggaatcatgtggggttgggtggggagcgggacagccaaggctgagctcctgggaaactcagatcgaagtagaagaaccccttctagacatttttgtgcgtctgggggacttttccccttctcgccagtctctggtgcgcccgccgctccccactgctcttttcctgcttctgttttgcctccttccccagtttcttctagcttaactcccagcctggttcgagttaccgatattcgtctgcaccctctggccccgtcttttgcccagcgtggttgactatgccgggactgagacacggcatgcgttccctcggcatcttccgtacagcggagcgtgcaaggagtaggaaaagctgataccctctctcactgaggtctcaaagttaaatgattatcttgtagtttgtagtgatcagcgagattctccgtgtccaaggtgggctagtcaaagtgtgttcgtttttgaatgatggtatcttctggtacttcaaagtttctgctgttacttacaactccactcgtgcaagcttgacggaagttctgatttatgatcactcacattcttcgctcacttcttgaagtgaagtctggttattgtttttgcatagcagtgttatgcctctgcctgaagttttctgccgaaaactttactcaggaggacatttttccatttctgacagttgtgtttggaaaagagtttcccagctattgccactttacttgagattgtgcttttagtattttggggatcactttgtttgcagttgccttgagtcaccttttcatacagtggtcttttagtgcttttagagttatgagttaagtagatcatcagagttaattaagatttatttgctgatacattgacagtctttccagaccagtaatgatctggttttgctattgttacaaatggtattacaggataagaaaatgcatgtcctcacagatcatcataggaagtatctataataaagtaaatatctaattttttttaatagtgaccactgaaatgagatctggcgtgagctggggagagtggactcaaccccccttcccccctcctttttttttgaaatggagtttccctcttgttgcccaggctggactgcaatggctgccatctccgctcaccacaacctccgcctctagggttcaaatgattctccttcctcagtctccccagtagctgggattacaggcatgcaccaccacgcctggctaattttttttttttttaagtagagacggggtttctccatgtttgtcaagctggtctcgaactccccacctcaggtgatccacccacctcggcttcccaaagtactgggattacaggcatgagccaccgtgcccggcaacccccttcttttttttttttttttttcgatacagagccttactgtgttgcccagacgtgagtgcaatggcgcaatctcggctcactgcagcctccgcctccctggttcaagcaattctcccgtactcagccttccgaatagctgggattacaggtgctcgccattacgcccagctaatttttgtgtttttagtagagacggagtttcgccatgttggccaggctggtctcaaactcctgacctcaggtgattcacttgcctcgcctcccgaagtgctgggattacaggtatcagccaccatgcctgccacgcccaccgcccccacccttccttttttttttttttttttttttaaataagatagagtcttgcttgttgcccaggcaggtaactcctgggctcaagcaatcctcccacctcagcctcctgagtagttggaattacaggggtatgccatgatacctggctttcagtgattctcagtatagtaaaaactacagcacttatgttcattctaaattgcggtctaaatgaaaacagtgacaagtttcagctgtggctgttacatgaagtccccacacgttctgacatcgaaacttttggtatatatctgcctgcttatagtctttttatcttctctacttggtgaatgattgttcattcttcacacttccatttcaaactactcttctgtgaagccacccctaatgcctctgggctaagttagaccctcagccaactctaccaatgagccctttatattattttatgatcatgtgatcagggtctctttttcttactagaatgggcattcaccctgggaaaaggtgatgttttattaatttacatcctctgcacctagcacagggcctggttaattgatttttagtagatgttgttcagtgtctgtggaaagcctgagagtaaggacagtctttaagtggcgcatagcacctagtccttagtgtattttatcagtaagctattgctaagtaagaaccgcaacatcacagtggcatacaacagttagtatttattttgttggtgcatctgggggccacctgggagctgaccgacataggctgtagtcatctgggtatctctatgatgcacatgtggtccatatgtctctaatctttggactagtgggctgaagtcctcatggtgatagcagaggtataagagcaagcccaaccacagagacacattttaaacccctgctcacatcatgtgtttatttcctattggccaaagtaagatatttggcaaaggccaaattcaaggggcagggaaatacaactccttccttggaggtgacaaagaggaagtgaatatttttctattacaatttaatcgatcacatatattaaacatttacaagctcttagtaaatgtatttcaaatgaatgaaccattcctatcctatatgcatctagtactggaaaactataaggaatctaagcagtgctagagatatgtgactccttttctcgctcgtgggacatctgaagaacatctgctctgtctacttgttttttcctttaaaattctgtctttccattaccctatagagctccaaggctgtctcatggccttttactttatgttaactattcagtattttctgtgttttgtaattaacaaaacataggttttgagagaaaacctggttgacctagtgcatcatttggttccaggttacatggtaagttgccaagatttgagtcaagcgagtacttaaattagatgaggtctggaagatgatgaatcaatatcagtagaggttatggatgttgttctgttttcctctttgttgagtctcattacatgttgacgaagatggccactggcaactccgggctttcatatccatccagctagtaatccagaagaaataactcttttccccaacatccaaatcatttcctccaaaggactctgataggccaaggttagaccaattgctgtgtccagaatggggcactttggctaacctgggttatcagcctaccctgtggcaggtaaggtaacaacctcactagaattacatagagtgagagaggggcagttcctaaaaggaggcaatgtagggcagatgaaaaagtagcaatgactgttacacacgtatttacaaaccacctaccgaatgaaaaatgttgcctagaggtatgaatacttggctgaagaatctgattatggaatatttcacagttcagtttatatcaaagcaggatgctttttcctggattggctaattgaaaaagttggttaagaggtgaattgtaataacgatacatattccaagtgaagttattttctgagtgtcaaatctttctaggtatttgtaattcttcaaatgtttatagttggcttccaacacctaaactgatagtaaacttttaagcaacttacctttatctttctcaaacattcaacttggcttttagggtaacgttaactccctttcagctctatgttattagttttgtaatatttaattaatgacaagttaaatatttaattgatgacaaatttaatttgttattttgaagaataagtagaataaaaaggtttgtgaagaagcacagttaacttggcaagcatacaacttgacactggcgtcagatgcatctaagtcttgatccagtcctaggtctactaccacgtactggatgctcttcactgatctatatcaagtatttagattgttttggaatgtatttttgtttcacctttattcttgactttgttttatatgcttacttttgctttctctttttcttcataaatgttatcttgttgtattgttcatctttttaagccatcttgaatccttttggtaatagttgtcatataagtcttccataagttgttggaatttggacaactttttactttctaacctcagttttctcttcacttaatgggagtgataacacatactttggaaggttgttttgagtatttgagataatatttgtaaaatgtttagcttggaatctgccacatcatagactcaaaataaatagcagctattgttattattattattattatttgagacaaagtctcactccatcatccaggctgaagtgcagcagtgtgatctcggctcactgcaacctccatgtcctgggttcaaacgattcttgtgccttagtcttctgagtagctgggactacaggtgcacaccaccacgcctggctaatttttgtattttttttggcagggatggggttttgccatgttgcccaggcaggtctcgaactcctgagctcaagcaatctgcccacctcagcctcccaaagtgctgggattacacgtgtgagccaccatgcccggcctgttgctgtgtcttaaaaacgggaaacactatagcttccgcatgtaaaggataaggttttctggtttttacttgcatccctgagcatagattcatatataaatatagggattcagaattctgttaactgtccttttaactgtagggtaactggaattggccatttttgttgagtggatcccaaatgtcagtatctacaggtctttttttcttgttccaatatccgagaaaggaaacctggttaagtatccctaatacaaaaattaaagatcttaaatgcttcaatatccgaaactttttgagagccgacatgttgccacgaatggaaaattccatgcttgacctcatgtgacaagtcgcaattaaaatacagtcaaaactttgttttatgcataaaattattttaaaaattatataaattgccttcaggctatgtgtataaggtatatatgaaaaacaaatgaatttcatgtttagacttgggtcccatcccaagccttctctttatgttttgcaaatattcccaaatccaaacaaatccaaaatctgaacaaattcaaaatccaaaacacttctggttccattttggataaggggtactcattctatattgcactctcctctctggcaggcagatataagactagctgcctattatctggaagctaagtgaaggaaagggatattgatcagaatgaagagcctgttatactactttaagctgtactcgatgtttaagatcagaactgttactcatcttctctagaaatgtatctatcaaagtaccattgtggggaagtgtagttgcctggtgttgatgatgtaatcagggcatctagctactcttctaaaagattttcaaccaatacttttgtgtttagccttactcctctacccatctggtcttcataagtgtttctgtatagttatgatcagtttagttagttctggagtaaacaaacatttcaggttaataaatgggtctttgacttccattgtgttcagttgcatacgttgtttacctaatgggtttagggaccttaggacttgatgtcttttttttcttcttctgatacttaatcttttgacatgaacttatttggtatatagcattgatatttgactaaatagctcattgacttacttaggagaatgagaaaatgccttgactattccttcaccccagataatttcatttgaatattatttaattatataacatgggtatttgaaggaggtcttctaaaagtggtagatgataaggttataacttgatgggagatttgagcatcccttcagttcattaaactaccaatattattgatggccttaaaataactgaatcttctttttaaagcaatgtcaaaagtaatttgacttgatctcctattgcaattacttttacctaacatggattatataaatgtcttatttgttctaaatatgttgcctgttactttcattgagtattagcttgttgtcgtattgtcgatcatgtagatcacgttgtcatactgtagatcatgcagatcatactaaactatgtaagccccttccagtattatacatgtggtgacttaaattattttttacattagcggtttatggtaccattaccttgacatcagagtaccttggtgccattaccttgacatcagagtaatttagactattaaaaggtatttactgtttggagtttaattgggcaagattgaagataatttataatgtctacattttatatttttaaaaatttaatactttgttttttcctaagagtaagctctgttgagtagtttgtttttcttcctgttgcccatagttgacagactataataagaccctgtattattattattatttttaaacagaatcttgctctgttgcctgcgctggagtgcagtagtgcagtctggctcaaacaattctcatgccttctgtgccttctgcctcccaggctcaagcagttctcgtgcctcagcctctcaagaacctgggattacaggtgcatgccatgcaccacctaatttttgtatttttagtagagatggggtttcatcatgttggccaggctggtatcgaactcctggcctccagtgatctacccacctttgcctctgaaagtgctgggattacaggcatgagccaccatgcctgaacaagaccctgcttttgattaagtcttttaaacaattaaaaataaagaaaaccttcaaagagagactaccttttccgatcctccatttaaaaaactaaccttctaaaacttctacatagtatataaaatttaaacatttttcctatgaaatatattcatactgatatattttcttgattattttgatctcagtttgcccttctacacataagaattatgcatctttggaataagtgttccttttttgaaaatagaaaccactctagctactttaagcagaaatgggtttagcatagtgaattaagtgcttacaaaatcactggagaaacagtctaagagtgaatcccagaacaacagagtgccagaacagtataaagctgcaactggccagccaagtgaaatactacctctaccacaataaagaacctgaagctgtctccaggattatatcactttagctgtgatctttggtgaacaggaagctgctgtgccataactatagattctagaagcaaagtatgccataactatagattctagaagcaaccaggagaagtgatgccacttgtgctccctctcactctccattaaattagagagtcaacactggaacctctgttaaagctgcttcagaaaaaccaagtatctttacaactattctaagcagcacaagttggttgtgaattatagttaacaccatctttccttgtttcaaatctcatgttagtgcatctgattagttaaaccaaaatcacatctgaaactttggctgctacggattccaggaaatacagcttctagctttccaactctataaaatagaaaggtatcttggaagctggaatggataggtgatgccggtttatcatattctctacaagcagaggtgttaagagtttagggtctgtagtcaggcagcctggattttaaccttgggtttgactcttgtgagctctctgacgttgggcaaattgcttaactgccctgtgttctagttttttctctcacgtagtaggtatctatcccatagtgttgtttgagtatttaatgaagaatgtggtaagacttgcattaattcttactcagacatgtaatgtaattttcttgtaagcaatctgggcctggagttttctttgtggtaagttttatatttatgaattcagtttttgaaatagtttagactattcggattttccgtttcttcttgtgtcagttttagtagttgtgtttttctaggaatttgtccatttcatctaaatttttaaagttagttttcataaatatccctttattattattttttaatgtctgcaggatttatagtaacctccctgtatcacattgatagttcttccttttttcttattagtcttattaaggatttatcagttttatcaatcttttcaaagaaacaacgtttagtattatcgatcctctctcctgtgtttgttttctacttcattaacctgtactcttttagggatctattttgcttatttttcaaatttttgcaatgaatgcttattaacttttggcctttctgtatttttttctgtaagcctggatttagctgcatgtcatatgttttgaaatgtatttctattgtcattcaattcaaaatactttataattttctttgttttttcagagatagagcctcactctgttccccaatttggagtgcaatggcttcatcattgctcactacaacctcaaactcctatgctcaagcaatcctcttgcctcagcttcctgagtagctaggactacaggcagacaccaccacatcctactaattatttttattttaaaatttttttgaggcagagtctcgctgttgtcaaccaggctggagtgcaatggcacaatctcggcttactgcaacctctgcctcctgggttcaagcgattctcctgcctcagcctccccatcagctgggattacaggcccccgccaccacacctggctaatttttgtatttttagtaaggatggggtttcaccatgttggccaggctggtctcaaactcctgacctctggtgatctacccacctcagcctccccaaagtgctgggattacaggcgtgagccactgtgcccagcctatttttattttttgtagatatggggtcttgccatgttgctcaggctggtctggaattcctggcctcaagcagtcctcctgcctcagccttccaaagtgttaggattacagacatgagccactgcacctggcctatagtttttattatgtgttctttttctgtttcacaggttatttataagtacattgcctagtttccaaatatatttggcttttcaaatatctttttctttatttttgtttgcttatgagtctgaagttattttatatctaagatttttctatcatgggaaatataaaacatatataaagctagagagaacaatacaataatcattcaggtactgataagcttcaacactgttaactcatgaacagctgtgtttattctcacttctcccattgccccaccaccattattttgaagcaaatctcagatgtcattttttctttaaatatttcattatgaacttataaaaatgacattaaaaaatcacaataccacatcaacccagaataattaattgatgtcatgaaatatctgatcagttttcaaattttccccattttgtcataatttttctttataatttgattattttggaggaggatccaaataaaatccaagcattattattggttgatatgccccacacttaaaaacctggcttttagcaacaccagcaaaattattcattatgctaaaacatacataccttgcatactcaatatacctccccattcctaggtaagctttgaaattcaacttttctctcctagctccataggttgttaaagaagcagcttatcttcttggttctttcttttagaattgacacatatccccaggagaaaagtggttgcaaaagtcagagtaacctttgtaggttttctccttttaaagatataagactgcaagccaagtgctgtggctcacttctgtaatcccagcactttgggaggccagggttgaagatcacttgagcccaggagtttgaatccagcctgggtaatatagggagaccccatctctacaaaaaatttaaaaaattaaccagacgtggtggtgcatacttttagttccagctgctagggagcctgaggtaggaggatcgcctgaacccagctgggtgacaggctgggtgacagtgaggctgcgtgacaaagtaagatcctgtctcaaaaaaaaaaaaaaaagatatcagacttgtaaatcttcactgtctttgctctctgatgtcttcaagtaatgctttaaaatattttgttcatcttttatagttatcttcagtaggagatatatctgaattatctaatctgtcattattagaagggaaagtccccttaccacttaaattttgaacattttgaacactaaacttactatatgtttagataacatgactgcaatatttggctttatttcaaaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggtaaccattattctagttaagattttgtaaacactagatttctcttggataagaaaaacaatctaataagaatcatcattatttattctattgagtttacgggcaatctttttcagaacttaggttttacaacttgttttaggaaatcctgctattttaactgggtcttgctgtattatcagactaaaggaaacaagttctcacaaatatagtggcatttgaagataaggtggttgcaaatcaaagggttcatttaaacattctgtcataacatttgtttatgacaaaaagccatgtttgttctgaggcaaagaaggggctgaaagtgaaaacagaatttttccaaactacccttcaagtaataatctgaaaaatcaagctttggtattttttccatttatttatttttttattactttcagaatagaatcaatcttaagactaaaggagaaaattcaactgaaaacactgatattgtaagaagcatatggactgttctgactttaaaaatcattagaaaagagacaagagagttacagactgcaataacaagataccattttactgaattaattttctctcacagttatgttctagcatgttgcaatattactgtaggtgtttgattttataaaatctgccttttctgacagtatttcacattttgaaagggagggaggagcacatttacagtaactgtaagaagagcaaaaaacattttaagtgtaaatgtgactgaataaggtttaggtgaggctaggaataattttaagaaaaaaattttcacaaagggtatctttttatagtatatgtttctcgagctattttagtttagaatatctaagctttaaaacataatagctaaaaattgggatttggataaaaattgactaggttgggcaggaaagaacaattagaatctggttttataatactattttactgaaaatgccggctgggcgcagtggctcatgcctgtaatcctagcacttcaggaggccaaggtgggtggatcacttgaccctaggagttcaagaccagcctgggcaacatggcaaaaccccacctttacaaaaaatacaaaaattaattgggcatggtggcatgtgcctatggtcttagctactccagaggctgaggtggaaagattgattgagcccgggaggttgaggctgctgtgagctgtgccattgcattctagcctggatgacagagtaagactctgcctcaaaaaaaaaaaaaaaaaaaaaaaaaatcaaagtaaagaaaatgccaaataaaatatataaacttacagattttggggtgtacctgtacattaattatgagattctcattaggataccccaactgctttgccttttgatggagataatcagttttgtccttggttagaaaggaaagaaaggtatatgcttactctgtgtcaggtacagagctaggtgttttgatgtattccatttcaagtgatccttacaataactttgtgaagcaggaatggaaatgattaaacatttagaaggaaatgaaagacaagaaaggacagagtgatccagtaggggtctttaggtataaagttctaaaacttatcttctgcatccactggtgaaaagagacaataagtataaattatagcaagaataatttcctgacatcttcaaggccctggtaagggttagccagtgagaatgtgaaatagtctcttcttgagatctttcaaagcaagtcatggttatccacttgtagagatgatcctcatgtagtactatccagagcccaagctatagagtaaactgggactcctttccaacagcattgttctttgtgatatatcttcttgtgatatatgaaagaataaatgtatatctatacaaatatgacattgagttggaaaaaagacacgtgactgagctaaagtgttggcttcattggctgccaagattttttttttcaaactagttagtatctgtccacattagtgcaaaaataacagtactttgggaggccgaagcaagacgatcacttgaggccaggagttcaagactagccttggcaacatagggaaaccctgtctctacaaaaaattttaaaaattagccaggggtggtggtatgtgcttgtagtcccaggcactcaggaggctgaggcaggagaatccttacagcccaggatttcaaggctgcagtgagccataatcatgccactgcactccagtttgggcgatagagtgagacccctttagggattacaggcttgagccaccatgcctggccagggtttctgttttttttttgttttgttttttaatattacttggaatagcccaaagcagtggtttagaagtagttttgcaatgaagtggagtactctcatcttcctctatattttttaagtttgtttaatcagcagtaatgatgattgaaaaaaaagggatgaatagtgttaaattcaaaccaataaatatttaatagcaccttctatatatatataaaaaaacagaaataaatataaatatacaatactatgcttaaggagctgaaatagataaaagttaaataataaaaataattaaataaggaaagttaactattcagtgtaagaactctcaccaggctgtgcataagtactttcaaaatgagtggaatactcacacttaatagaagtttagaggtaggagtgagttttggaaatgatttttaaaaaaactggatctggaagtacttgaaagttctgggagaaggggatgcccagatgatggcaaagatactagaaaatacacagggtaagaaagagcaagacagaatcatcagaggctactgagaagaggccattgcagtctttagctggaggaatgattatcaatatatattatatggtggatctgctccaggttcttggttttttttttctttttagagaaggagtctcaatctgtcacccaggctggagtgcagtagcccattctcagcttactgcaacctttacctccagggttcaagtgactctcctgcctcagcctcctgagtagctgggattacaggtgtgtgccatcacacctggctaatttttttgtatatttaatagagacagggtttcaccatgttgggcaggctggttttgaactcctgaaatcaagtgatccacctgccttggcctcccaaagtgctgggattacaggtgtgagccaccacgcccagcctgctccaggttctattaaggggctaagcattggagattttgggctgggcacagtggctcatgcctgtagtttcagcactttgggaggctgagaagggtggatcacttgagcctaggagtttgagaccagcctggccaacatgctgaaaccctgtctctactaaaaatacaaaaaaaattagctggacatggtggttcatgcctgtaatcccagtatcccagttactcggtggctaacacatgagaatagcttgaacgtgggaggtggaggttgcagtcagatgagattgtgccactgaactccagcctggtgacgaagtgagactctgtatcaaaaaaaaaaaaaaaaaatagacactggggatgttacaagttcctcacaaatcataattgtaaaccccattttcactttctcagttcttatcgcctaagatcacctgccacagcttaacagagataacacacacagggtgatcagcacttgttatcaatacctattagttttgtctatcttaaacttttgctacccattcatttctgtctccttaaagttttattagagttgaagtgaatacccccaagagggttaatgcctaggtatttgtgaattcaaaatacctagttgtatcttgtttatataagcagtgaccttaaaaactttgaccattattttctgtcagccttacatgataataattaaaatgaaggaataattttcccttagtgacttttcatctgaagctaaagtttaaacaatgtaaaagttaggttacaaaactcccaaggtttgttgtcgtctttgtctacctgtggatggtgactctttgtttcaaattacgtgttgagagttatgaaatgaaaatccagggtatgactcctggattttgttccttgacaaactattcttgcctttctggtactttctttcttcctcttttttgagacggtctcactctgttgcccaggctggtatgcagtggcatgatcatagctcactgaagccttgacctcccaggcttaagcaatccgcccgccttagtctcccaagtggctaggactacagttacatgccaccatgcccagctaatttttgtatattttgtagagatggggttttgctgtgttgcccaggctggtctcaaactgctggggtcaagggatctgcctgccttgacctcccaaagtgctgggattacaggcgtaagccactatgcctggactttggtactttgtttcttagaactttgtagaagaggctcttgttattagatagatgcaagtatataagctaagagacaccaggagatgtttataccaaaattctttgattaaaatttccttttccctatctcataaactataatatattgttgtataaagcttgctgtgtagatacaagaaattgttcctatctcccatatttcaacttaattccagcacagcaggaatttgcatattctggaagctttaaattgcttccattatatatggaaccatagaagtgcctgagttattcatttataagtgtatacgtgtcttaggtatagagaaagctgagaggcctgaactgtccttctttgtttgaagaagactactgttactatggtaattgctgaattagaaggctagaactcttgacttttgccttgtcctgggaacttagaatgggcaaaaagtcaagaatgactttgtctttgactgtgttgcatctttctattataacaaatgcactacaccgagatcataccttccatttctagggaaagaaaaagacaaaccaaaccctcacctcattattttagttatatagcttgtgaatgttcagtaaataaaaactagtgattagatggtttgcttatgaaattagatgtatggcagattatttttgtatgtgtagtataacctaggtacgtatatagagcttggcgaggctggcatctaagacaaatacgaatactgcatctatatttaaaagcatagttttattgttagtagtgatattaacaacagaggtgattatagcaataaaacaacgttttttaggacctttaaaatatgatccgtagtttccagaaaactgtgaattccattgtgtcacatttttatggatcttaaatcatagatatgggctagtataacttagttttctaatttgttttaaatttcattgcaattttttatgtaacgtgcttacatataaatatactgtttcagtaaattgaaatgttcccttaaacattttccaaatcccaatatagtacatgtagaaaccatctactaatttcctaaaacccatgagactggaaaacatctctttagctatttttaaaatttgtaatttttaagcacttatttttgaaagaactccaaagcatctagaattaagtttgtttgtttgtttgtttgtttgtttgtttgtttgttttgagacagagtcttgctctgtcaccaggctggagtgcagtggtgcaatcttggctcactgcaacctccgcctcccgggttcaagcgattctcctgcctcagcctcctgattagctgggactacaggcatgtgccaccacgcccagctaatttttgtatttttagtagagacggggtttcaccatgttggccaggatggtctcgatctcttgacctcatgatccacccaccttggcctcccaaagtgctggtattacaggcgtgagccaccgcgcctggcctagaattaagtttttaaaaccttctgaaaacctctcctctttgttcttctgcagccttttaggacccactccactctctggcttactttgtatttttggatcaattttcttttactcacaatacaatttacataacaaaatttgctattttaatcactttaaagtatgcaattcagtggttttaagtatatttacaatgttgtacagccttcaccactattccagaactttttcattaccctgaaaagaaaccccatatacattggctgtaactccccattctccttcttcctctagtccctggcaaccagtacttgactttctgtctctatgtgttgtctgttctggacactttatgtaaatggaatcctacaatatgtggccctgtatgtctgtcttctttcactgagcgtaatctttttaaatttaagattcagccatattgtaccacataacagtacctcatactttttttatggcatcccactgtatggctaatgtattttgtttttttcatcagttgatgaacatttggattgtttctaattttgggctattatgaataatgccactatgaatatgcatgtacaagtttttgtgtgaacatatgcttttaattctcttgggtatgtacccaggagtggaattgctgggtcatgtggtatctctatgtttaactttttgaggaatagccaactatttttcatagggctgtaccattttatattctaggaatgtatgagtgttttagtttctccccatacttatcagtgaagcacttgttaatttttcttcttttttaaaaaatattacaacccttatagtggatatgaagtgatatctcactgtggctttgatatgcatttctctattgtctaatgatgttgagtatcttttcatgtgcttattggccatttgtattttttttcttttttttgagaaatgcctattcaagttctctgcctgctttttttttaatgttttattttctttccaatgggacttttgcactcctgtctttgtgtttttaattgagctgtctctttttattgtcagagttatttttatatattctggatattagaccctatcatacatgtgatatttgcaaatattttctcctagcctgtgcattttcttttaactttcttgatatgtagtatcttttgatgcacaaaatttttaattttgatgaggtgtaacatgtctattttttcatttgttatctataattttaatgtcatatttatccatggcttgcttttcacctctagtttcaacctcttggcatgtttaggcttcagatttttcctctagcagcttttctttttccctcttcaaataattatctgccccaatgactcgttcctcagtccttactcagcaggccatttttaggaagaaactcaaagttcctcagttctaggatagctttaggtgcttgtgaaaaaaatggtttggccctggggagaagaatctggccattgttaatggtttgggataaagctttgaagtttaggacaaagatagagtgaactttttatactctgagtatgttggcaaaaaatcgtagttgtcacataacattaattacaagtataatgctaagactgaagtttttaagaatttaagtttgagcagtttcttttgttataggcattactagcgaaccacagagatcagacaggacctaggtaaatagttgaaaaactaagactagacaagagcttgtagacttgacgcttgaataaagtagatgactcagtgaaaaagaacagtccttaagtttggaacaaatgaaatggaacttgaagtaaccaaactgaatctttgtcatactatattgatagcagttttcctataattagaactaacttcttatagttttgaaaatagtgattattaacattattctttcataagatgccatcttttagggtttttaaaccctgataacttcatggataattgatttcatttttataagtatcttagaggtataggatgaggtttactgtttctccactgcctacccccttaaaaaggtcatatggtaagcattctgtttctttaagaaataatgctttcggccgggcatggtggctcacacctgtaatcccagcactttgggaggctgaggtgggtgggtcacgaggtcaggagtttgagaccagcctggccaacatagtgaaaccccatctctactaaaaatacaaaaattagccgggagtggtggcagacacctgtaatcccagctactcgggaggctgaggcaggagaatcgcttgaacccgggagacagaggttgcagtgagctaagattgcgccattgcactccaccctgggtgacagtgcaagactccatctcaaaaaagaaataatgctttccagaatgacaagttttgcttcagtgataagttgaaatcaaattttttattttgaatagtgtttttaacttttaaaacatgtacttaacttctattatctcagtttgttttttagaaattaaaaaaaattaccattattacaaaatatgtgcatgttatttctacttgtttcagatttaattacaagtatttatttcatcctgatatatgagagacagagagggagagagacagatgcaagaagaagagaatattcttattaaaattaggccataaaacaattccacttttagcaatgtatcttaagtaaacaatcagaaatagatttgatgttttccacaagaatgttcactgcagcagtgtgcacaatagtacaaaattgggcacaatcttaaaatccaacataaagttctggttcaataaattatggtgcagacatccattgaacttggcagccattaaaatcatattatgggatattacttaatgatgtgggaaactgtttataatacatactttgttataattggtgaataacaaattgcaaaacaatatggacaagtgctttcagttctttaataaaaggaatatgtgaacatagaataagatttgaaggctgcgtaccaaaattctcatgttatctctccatgttaggattatgagcagttttttcttgaaggaaccgtatattgcttttatattaaaactttttttggatttcaatactgtattgttgataattttaatagttttatcttacacttttttttttttttttttgagatggagtttcgctcttgtcacccaggctggaatgcaatggcacgatctcggctcacagcagcctctgtctcctgggttcaagcgattctcctgcctcagcctcctgagtagttgggattacagacgcctgccactacacctggctaatttttgtatttttagtagagacagggtttcaccatgttggccaggctgatcttgaactcctgaccttaggtgattctacctgcgtcaacctcctaaagtgctgggattataggcgtgagtcatcttgcattttggaggttaaatattttgctcattttcatcttttcttagtatttactgtagttttccatattagtgtaaataacctcatctctacctagaatcttataggcccagagaagacaaagaatcattatgttattatgattgttttatttgtgattggtgactttgttttttcagattatgatactttggggcctagtgcttatttggtcagtcatattgcaaataacttttttctttttctttttctttttttttttttgagacagagtctcgctctgtcacccaggctggagtacagtggcgcgatctccactcactgcaagctccgcctcccgggttcatgccgatcttctgcctcagcttcctgagtagctgggactacaggtgcctgccaccacgcccagctaatctttttgtatttttagtagatacagggtttcactgtgttagcctggatggtctcgatctcctgacctggtgatccacccgccttggcctcccaaagtgctgggattacaggcgtgagccaccacgcccggccaacttttttcatctcatttaattaccctgtcaaaggactgggcctctgtggcagaaataaagaaaagctctatttttatggaaagggtaatacagtttacacgtattctcttactatgttttagtttgcttggctgccaaaacaaaacaccacatactggggggcttaaacaagagaaatttagtttcttgcagctctgggagctagaaatctgagatcaaggtgttggcaggtttggtttcttctgaggcctcttccctttggcttgcagatggccgccctcacactgccttttcggaggccattcctctgtgcatgcatgaccctgatgtctctctgtgtcctacctcctcttttttttttcagttgataatttattttattttattttagttttattttttgaggcagaatctcgctctgtcacccaggctggagtgcagtggcgtgatctcagctcactgcatccttcacctcccaggttcaagcaattctcctgcctcagcctcccgagaggctgggactacaggcgcatgccaccacacccggctaatttttgtatttttattagagatgaggtttcaccatactggccaagctggtctcaaactcctgatcttgtgatccgcctgcctcggcctcccaaagtgctgggattacaggcatgagccactgcacctgacccctttttttaatttgtaatttcaattttcatttttttccataagttattggggtataggtggtatttggttgcataagtaagttcttttgtggtgttctgtgagattttggttcacccatcagctgagcagtatacagtgtaccatatttgtttatcccttgtacccctcccactcttccccgcaagtccccaaagtccattgtatcattcttatgcctttgcatcctcatagcttagctcccacatatcagtgagaatatatgatgtttgattttccattcccgagttacttcatttagaataatagtctccaatcccatccaggtcactgcaaatgcccttaattcattcctttgtgtagtattccattgtatatatatatataccacagtttctttatccactcgttgattgatgggcatttgggttggttccacgattttgcaattgtgaattgtgctgctataaacatgagtgtgcaagggtctttttcgaataatgacttattttcctctgggtagataccaagtagtgggattgctggaccaaatggtagttctacttttagttctttaaggaatctccacactgtttccatagtggttgtactagttttcattcccaccagcagtgtagaggtgttccctgatcacagcatccacgccagtatctattgttttttgactttttgattatagccattcttgcaggagtaaggtggtattgcattgtgcttttgatttgcttttccctgatcactagtgatgttgagcatttttttcatatatttgttggccatttgtatatcttcttttgagaattgtctattcatgtccttagtccactttttgatgggattgtttgtttttttcttactgattcgtttgagttcgttgtggattctgaatattaggcctttgtcagatgtttagattgtgaagattttctcccactctctgggttgtctgtttactctgctgactgttccttttgctgtacaaaagctccttagtttaattagatctcagctatttatcttttttttttttttttttttgcatttgcttttgggttcttggtcatgaaatccttgcctaagacaatgtctagaagagtttttccaatgttatcttctagaattttgatagtttcaggtcttagatttaagtcctcaatccatcctaagttgattttttataaggtgatatgagtatccagtttcattctctgcatatagctagccaattattccagcaccatttgttgaaaagggtgtcctttcccccactttttgttttgtttactttgtcaaagatcagttggctgtaagtatttggatttatttctggtttctctattctgttccagtggtctctgtgcttatttttatatcagtaccacgctgttttagtgactgtggctttatagtatagttgaaatcaggtagtgtgatgcctccagatttgttctttttgcttagtcttgctttggctatgcaggttcttttttggttccatataaattttagaattgttttttctaattcggtgaagaatgatggtggtattttgatggggattgaattgaatttgtagattgcttttggcagtatggtcattttcaccatattgattctacctatccatgagcatgggatgtgtttccaattgtttgtgtcgtctgtgatttctttcagctgtgttttgtagttttccttgtagaggtcttttgacgtcttggttaggtatattcctaagtattccttttttttttgcagctgttgcaaaaagggttgagttcttgatttgattctctacttggttgccgttggtgtatagaaaaactattgatttgtgtacattaaccttgtatttggaaattttgctgaattcttttatcagttctaggagctttctggaggagtctttagggttgtcgaggtaaacaatcatatcatcagcaaacagtgacagtttgacttcctctttactgatgccctttctttctttctcttgtgattgctctggctaggacttccagtactatgttgaagagcagtggtgagagtgggcatccttgtcttgttcctgttctcagagggactgctttcagcttttccccattcagtattatgttggctgtgggtttatcatagatggcttttattacattaaggaatgtcccttgtatgccagttttgctgagagttttaatcataaagcaatgctggattttgtcgaatgctttttctgcatctattgagatgatcatgtgatttttgtttttaattctgtttatgtggtgtatcacatttattgatttgcatatgttaaggcatccctgcatccctgatatgaaacccacttgatcatggtggattatctttttgatatgttgttggattcagttaactggtattttgttaaagatttcaacatctgtgttcatcaaggatatcagtctgtagttttcttttttggttatgtctgtccctggttttggtattagagtgatgctggcttcatagaatgaattagggagggtttcttatttctttagcttgtggaatagtgttaaaaggattggtaccaattcttctttcaatgtctggtagaattctgctgtgaatccatctggtcctggacttttttttgttggtaattttaaaattaccatttcagtctcgctgcttgttattgttctgttcagggtatctaattctcatgctttactgactgggctagctgggtgcctcagggtatctaatttttcctgatttaagctaggagggttatatttttccaggaatttatccatctcttctaggttttctagtttatgtgtgtaaatatagtagccttgaatgatcttttgtgtttcagtggtgtcatttgcagtatctcctgtttcctagtgaggttatttggattttctctcttcttttcttggttaatcttgctaatggtctatcaattttatttatcttttcaaagaaccagctttttctttcatttgtcttttgtattttgttgttgttgtttcaatttcatttagttctgctctgatcttggttattttctttcttctgctgtgtttaggtttggtttgttcttgtttctctagttccttgaggtgtgaccttagactgtcagtttgtgctctttcagtcattttgatgtaggcatttagggctatgaactttcctcttagcatcacctttgctgtatcccatagattttgataggttgtgtcattattgtcattcagttcgaagaattttttaatttccaccttgatttcgtttttggcccagtgcttatttagtagcaggttatttaattttcatatatttgcatggttttgaaggttccttttggagttgatttccacttttattccaccatggtctgagagggtgcttgatataattccagttttcttaaatgtatttaggctcgttttatggcctatcatatggtctgtcttggagaaagttccatgtgctgttgaataaaaagtttattctgcagttgttggacaaaatgttctgtatgtatctgttaagtccatttgttccaaggtatagtttaaatctattgtttccttgttgactttctgtcttgatgacctgtctagtgctgtcagtggagtattgaagtcctctactattattgtgttgctgtctatctcatttcttaggcattagtaattgttttataaatttgggagctccagtgttaggtacatatatgtttaggatcgtgatattttcctgttggacaaggccttttaccattatgtaatgtccctctttgtctcttttaactgctgttgctttaaggtttgttttgtctgatataagaatagctacgcctgctagtttttggtatccatttgcatgaaatgcctttttccacccctttaagttaagtgtgagtccttatgtgttagatgagtctcttgaaggcagcagatagttggttggtgagttttgatctattttacggttctgtgtcttttaagtggagcgtttaggctatttacattcattgttagtatcgaaatgtgaggtacccttgcattaattgtactctttgttgcctgagtactttgtttttttttgtttttgctttttaacttgtatttttgttttataggtcctgtgtgatttatgctttaaagaggttctactttgatgtgtttccaggatttgcttcaatatttagagctctttttagcagttcttgtggtggtggcttggtaatggtgaattctctcagtatttgtctgaaaaagactgtaatttccttcatatatgatgcctacttatatgatgccttgtttcactggatacaaaattcttggctgacaattgttttgtttgtttgagaggccccagtcccttccgcattgtagggtttctgctgagaaatctgctgttgatctgataggattttctttataggttacctggtgcttttgcctcacagctcttaagagtctttccttcatcttaacttttgataatcgatggcagtgtgcctgggtgatgatccttttgtgatgaatttcccagagcttcttgtagttggatgtctaggtctctagcaaggccgggaaaattttccttgattattcccccaaatatgttttccaagcttcttcctcaggaacaccgattattcttcagtttggtcatttaacataatcccagacttcttggaggctttgttcatattttcttattctttttctctttgttggattgggttaatttgaagatcttgttcttgagctcggaatttctttcttctacttattcaattctattgttgagactttccagagcatttcacatttctaaaagtgtgtctgaagttttctgacattttgactgttttttcttaatgctatctatttccttgaatgtttctgccttcacttcttatattgttcttttggatttgcttgcattgggctttgcctttctctggtgcctccctgattagcttaataactaacctcctgaattctttttcaggtaaatcagggatttcttcttggtccggatccgttgctggttaactagtgtgatttttttgggggtgctaaagagccttgtttagtcacattaacagggttgtttttctggttccttctcatttgggtaggctccgtcagagggaaggtctagggctgaaggctgttgttcagattcttttgtcccactgggtgttcccttgatgtagtactctccccgttttcctatggatgtggcttcctatgagcagaactgctgtgatgtctctcctgggttctagctacccagtgagtctacctggccctgggctggtactggaggttgtctgcacagagtcctgtgatgtgaactgtctatgggtctcttagctgtggatactagtgcctgttctggtggaggtggcggggtggggggtacaatggagtccgtgagggttcttagctttggtggtttaatgctctctttttgtgctggttgacctcctgctgggaggtggtgctttccagagagcatcaactgtagtaatacggagaggaactggtggtgggcggggccctagacctcccaagagtatatgccctttgtcttcagctaccaggctgggtagggaaggaccatcatgtaggggcagggctaggcctgtctgagctcagaatctccttgggtgggtcttgctgtagctgctgtgggggatgggggtgagattcccaatacctcctcttcttataaagaaaccagtcacattgcattagggcccaccctaatgaccctattttaactaaattacctttaaaagccctattgctaaatatagtcacctttcgaggtaccagggttagggcttcagcataagaatttggggaaagtgggaggcacacttcagtccgtaattctatatatcacttatgacaagttttaaatgacaaagtgaatgttgaagtaaatttttatgaattatcaatggttattacaaacttttataacattctaaagaacttcagctgtaaattatatgggagagaatgtagaggattgtagatggattagcactaattttttttttcccctgagaaactcaaactctatgacctattgcacaattgagtctatttgtatataacaaatagtatttttcataggtattaataaaatatcagtgtcaagtcaaatatttaaaagagttgttaactgaagcgggattagaattaaaggcattagaattaagattagtgggcaaaagatacaaaaactttgctccctgacattcataactgtctgtagatggaatagcagacctgaagattggctatttctttgtgactgaagttctgaattttttgtgctgttatagagtaaatttatgtattgttgagtgtggttctggaaggtgatgatttttcagcttgattctctaagtatactgtgtgggtttttggctttaaaaaggttaagaacttccctttacataatgaaaacccaacaagtaaatattatttgttagtactttaagatgtagattaatcatttaaaaagtcattatgttaaatattctgaggaccatactgttatttctttccttctccctctagtgggcagaaaatattcttaaaatatagcatggaataatttattgctattgggtataccataatatacagtctcagtctcagcttttttgaatactaaaaatgttaacatttcagaatcattaaagcaaacgctttactcctttctaggcataatagtggatccttgaatgttgaagatgtccttaccagctttgacaatacaggaaatgtttgtaagttatacattcactctatagaaatatatttagtgttttacaaagtgaatttatagttgatgttttcttctcactaatatttattatactcactaaatgtatgcatatatgtatatataatagaaagtttgactgtctttagctgcaaaataagccttgtataaggtacaccgacaaaatgggatactgcagtttctaaacttcgcaggtgtgtgtgtgtgggggggaggtgggggagggagagagagagggagatggagagagtaggtcagaaagaacactggacactgaagtactgtcccttttatttttgtttccattttgacctcagttaattcagtagtggggctgtttcttccttctttgctttgtttcgggtgctttctttgccattccctgcttctttactttcactgtagaataaacccagaacatatttttcttgatgctactatacattaataccagagtgtttttgtttgatgcagtattacaatattacagaatatattgccttttcatcaaagcttctgattaattggtgatagatttgtccactgagaaaatcacttaaatatttcttataattcttgtaattaatttcatgtgatgaaagacatcagccaagaatacctttatgtcactgagttaaacagcataccatcataggagctatggactttttatgttttttgtataggacatttctcttaagatagtgaattgtcaatgaaatatgagcattttaaatgtaaaaatagtactcatactctttttctcaaagaaaatttcagaactgttaacttttggctgaatttaggtagtgtctttggcttaacaatgcagttttatcaaataaatagatttgcatagaattgtgttcagtaatactcagacaacacttttgttcttatgtccacattatgataagcttttgattttatagaaaaatatttgtggttcactaaggaatctataaatgtccttaaattatcctaaatacctaaaataatgtaggtttcttttttatggatagtgactgatgtgccttttagtttctttctttttttttaaattttccaaacaccaacttgaacccgaatgccttttagtttttccatgttggcatttagtgaattctctcccacttaggtgtatctcatatttttattaggtctaggcaaggactgggcaaagcataccaatgatggttgaggatacatactcttttagttctggggtaatgttaaatatcattgagtcaggcttaaacatatgtaatttcagaaaatgattctagaatgttaaatgtggaatttttgattcagtaatgtaaaagtcaagtattgttcccagttggctccgtatgaaatagggccactagctgacagcattatgtaaaataaaaataatttcctaaaggcatcaattattattttaggcatgaatgactgtcttagccttctctaacattttttcccatcaacttgttccataccccgtgttgttgttgcatgaacaaacggaaatattgcatattcagggtgttttttcactgttgtctcttgtttggtagaaaggtttaagactttggaatgatactcacctgcatttgacttctggctctgaaattcatcttgagcaatttgtatcatctctatgaacctcaactgttttcatctcttagggctggctgtgttataaagaaagtacgtacatactgcatggctgagagttgatatgcaataaaagttattaattattactggcgatgagtacctatataacctcttttggttttttcctaataaagaagataatattattaggattattctgtcttatactattttaattgaactaacagggcagaaaaattagataaaattagcaaaatagctgtttattaaaatgcctcattataaatgttgccttaaaaacctggatatattgctgagtgatagaagtggtgacaaaaataagacctcttaaaatatgttgttttgtgtaccttttatgtttactttttattttaacagaaaaatctatatagatgtttcatttaatgataaattggtaaagtcctgttccaataaagtaaatattgattatgacttttatataatcttggacgtaaagtaaccatggactgaaaaagtgatttttcacttgatgcctcaaaaatttgattttattatgccaatagtgatattgagtttgtgactagaaaacccagcagagggcgccacaatcataattctttgtcatagcccaatataattaggataaatagctcaaataataaccctaagcttttaccatgtagacatataaagatgtgtctaaacatttctatttgattcatttataatatatttaatatattcagtaattcaaaaatacaaaaaaatagatttttcctggccgattttttaatttttaaaaatatcagtttaatttttctacttctagctttaaataaagaagtacttttgatagagagtgaaagttccatacaagagtatcagttcataaatcaccaccatggtagtatgttaaaggacaattagaatgaggaaaaaagtttctaatagatgagagaaccaagagatggaattatctatttattttaagaatttgtttctaggttaataatgcttcctagtaatagaaaaaacagcttaactaaaacattttctagtcacaaaaacctgatatgtgtagatacagtaaaaaaaggtatggtcatggtttagtagaaccattaatttcaattgtaagttcattttgaatatcaggggatgattatattcattgcaaattttcagagatgaaaggatcagtcttaccttctgaattggtttatgctctaagtgaaaagacgtggaaaaatctctttaattttggaaaataaacctctagataacttatttactattagaaaagataatttttttgtatttacttttttgtatagaagttttgtggttttaaatgtatgaactgcaaagtgttttatatttttgaggtaacttttcattgcttgaatttcttcgaatgttgtgggaagaaattaagaggaatctcgtacagaatgaatcacgtctgcgtattgatttattgctgtgtgatatacgacccaaccttctttttatatatttatatttactatggtggaaaacaaaccattttgaaagtgcttacctttaactaggaataggtatgtatatttcattatttggtttctactacttgagaacctactttcttttgagatatcaaagcttcttggtcaggaggttgtgtctactattgattcattgtgcccagaaagacatgctgacaagctacctagggaagagtataggatgacatctttcacctcagatgaggtactggctgcttctgtgtctcctttgatatgtcgctcagataccttgggtaacaagggagtgctctataagcattgtagcagatttcttgcttctgctttttctgtgggcagggactcctttctagcttgtcctctgacctctggtcaaagaagctgcaccatgctgtctcttccaaaatcattttccttttctccaaagttatttcgttccactactgaaaggaatttttaaaaatgtaattctcagtgcttacttgatccaaatttggataccatagtatctaatttaactatttgttgtttataacatctcatcttatgcttgggtctgtagtagattcattggaacattttaagcacatcatcctttgttgagtagtatgaacagaagtgttagtacttcgtataatttattataaactatgtacaatataatgtatataatcctttaaaggataggaggtcagcagttaaatcatttcagtaatatcattgtgaagcaggattcctggcaaatgttgcagcttaagtctgggggatgtattggtaaaacttctctactattctttgaaaaaaattttttttcttggttgagctccatgacaggaccctgtggtagttggtgtcacattatctcctggaggaatttgtagaccctctgccatatatacttgtacatgtgacagtggtgatttttgttttccctagtgaattctaagactgaccaggattttttttttttttaatggagtttcactcttgtcccccaggctagagtgcaatggtgcaatcttggctcactgcaacctctgcctcccaggttcaagtgattctcctgcctcagcctcccgagtagctgggattacaggcgcctgctactatgtccagctaatttttgtctttttagtagagacggagtttcaccatgttggccaggctggtctcgaactgctgacctcaggtgatttacccgccacagcctcccaaagtgctgggattataggcaagagccactgtgcctgacctgaccaggatttttaatgcacacagctatagactttgcttcctagtggtctgatagcagaatctgtttgtctgtttgtgatgtatctaaaactgatctcttttggggtggtaatcagttattattgaaagcaagactcattaaaataaaagtcaggtgtggaggtatgttcctgtagtcccagctactcagaaggctaaggctggatgattgcttgagcccaagaatttgaggcaagcctgggcaatatagcaagacttttcctgtaaaaaaaagacaatcaaatatttatcttcctggtttttctagaggaaaaaaaattatatgttttcactttttacttgtatttaggaaaccaaaggtaatagtttctttggaaatatggtctaaatttttagtttttctgtttcattgttgttatgttataaagttagggtttggaatgttggtgaaattatcaaagcttcaagaatgtcagcttggattttaaaatgctattcttattcaaataaagatgtctatatatgtaatgcatatgtatgtgtatatgtatatgtagttatataatgcatatatgtagcatgtgtgtatacatatgcatatatacatatatgtagtatatgtgtatacatgtacatatgcagatatataatgcatctatgtagtgtatgtgtatacatatgcattatatatacatgtatgcattgtatatctatatttatatacagatatatacatatacacagtacagtggtttgattaaaaaatgaaaaagttgggcttttatgggtcattgctctgtttttaatttagagtggttatggaaggtacatgggatatgaagttcaggttttagctctgcgggttattagctgtgtaattgtagacgagtctttgtacaagtcttaactccttatgtaaaattgaataggaaacaataagtactttatagtgaggtgaacataatattagataatgtgaaagtaccaagtaaactgtaaatagtatttgtattttttatggttagtaatatcatctgcctcattcttgaattttttcagtacctttgttattcaaaataatacaagatagaagatatttttggtatgtgccattctgttttaatatcatacattattttgttatgtgaaaacaatgtaaagctacacaattaaaatagtgtggcattattgcagaaatacacatataaatcaatatttttagaataaagtgttcacaaagacctaaatatatgtgacttaacatatgatgaagatacaattttagtaagagaggaaaggatggattctttaataaatagtattgggaccattgcctaggaatttaggaaactaataaagctgactccctcctatatactatatgccaaaataaatttaatatgggttaagtatttaattaaaaacataacactcttagatatttcagatgaataattttaatatattgaaatcaagaaggtccttctaagtgcgagtcaaacaccatgaatttaaaggttaatagattgactaatttaagatttaaagaccctttattcaaaaagcgcatcaaaaaaattgaaatacaaattacacactggcaattattatttatgacatatattcagatgaagatgtattttctttataaagagctcttacaaatccataataaaaagacaatctgaaaacctgtaagatagagaaaaacgtagccaaaaatttaagaagaggtatttcacaagagaaatagcaatgttctgtatgtacatcaaatggttattttattaggaattgaaggaatgatttttaaaagtgagataatttttgcttatcaggttggcaaagatgaaagaagttaagcagtaatcagtaaattgtagggaactgggtattctcatacactgttggtggaggggggtaggtaaattaattctacttttccagaggcagtctgattatatctttcataattttaaatatccatatctttcaactaatgattacctttctaaaaaaaaaaaaaagaaagaaagaaagaaaggaaccaggatgggaactgtggctcacacctgtaatcccagcactttgggaagccaaggtgggcggatcacaaggtcaggagatcgagaccatcctggccaacatggtgaaaccctgtctctactaaaaatacaaaaattagctgggcgtagtggcgtgaggctgtagtctcagctactcaggaggctgaggcagtagaatcgcttgaacccaggaggcgaaggttgcagtgagccgagattgcaccactgcccttcagcccaggcgacagagtgagactccatctcaaaaaaaaaaaaaaaaagaaaaagtacacaatattttgttttaaaataatacttttcttgaaggagctcacagcatgttagatgttaatgtattagtcccccattacacttatgagataaggaatcagagatcaaatcattttaaccctttcttaggttgggaaagtacaaagaggttaaagtcagtcagtggcagaatattgagctttgggaatagaaaatttataagttgtgttacaaaataaatatttaaggtcatcaatgcattatgtggttagaacgcatgggtaatgatcagcagccctgagagtataggggacctgaaagccagtggagcactgatggtatgcagcatggcagtggattcttagtccctctttagcatcgtaatgtacatgtagtctttgattcttagtctgtgttagaatttttgaaggttggcttcggttgctagatggcaatttccctagccatgtgtctccaacttcttagctccacagttgtcaggacggttttttcttttggctcaaaatcaggtaagcgtgcccctaattcataaacagagccctacacgtttgttatcaattaccagagaaggaaaaagacacatttgttatcaattaccagagaaggaaaaagacacatttgttatcaattaccaaagaaggaaaaagaagtctctttttaatgtattttaaaaatttctatttgaaataagaaaccacagaattggaatgattctttgacagtagaacttggtgctatcatgggaactgactgaaataaaccctataatcctttgtagattcatatgccttaatcagtgcaataatatagagaggtagctcatgtctttgtcataaacctgctagtttctccctcttttaaatatctaaagggatgtttctaatttaggtacttccaagttttagcacaagatatgccaagaaagtctttttatttttcccccgagcaaatactgagtagttttcctttgtctgtcttttaaatagctaccattacttttgcatcctttacagtatttgtcaggagctttgtaagtactgtcccgtttaataatcttaacgtctttacaaggggtgaggaaactgatgtccagaacaaggtaatttgcttaaagatttagtaggtggtggcacaggaatttaactattctactttatttcttaaaggctacatttctccaaaacggcgagaaatgaattttaaaagtttgtgatgggaattgaaacagaaagtggtaacttgaagggctagaaaataactttggcaaatggaattctgtgcagcagattgtgtctcagaggagactgattaaaggtcaagaaaaatgggctctccagggtttctgcaaggtagttgacaatctaatggaatggggatttggggagtgtggataagggacaaagaatgcgttttcttttaatagtcttaaaccaaatgcgggctttgttttacttcagtttctttcttttttcttttcttttctttttttttttttttgagaagtgctgatttttgtaacgataatacaatagtaataacaagttatgttttaacatagccccttctctaaggtacttctcaagcttatggctatatattttaaaagtgcttacataaacgtaaatcacccaaagagctcaactaaaaggatgttcttgatttttaacaaagttgtttggattgtggatagcctttccacagagaattgttatatttgacatttatatgaactgtgtatattgcactgctcttgttaatgcttgataagaacaaaatatttgatgattgaatgaatttagtgtttgtgtgtatatactccatgttaaaaaaaattttctcttctctgaacttttactctccactcagccctgagtctgaatattttcattattttctgggaggtgggaacagtttgcaggaaggaataaggaaaagtttccaatcattctgtgtgtatgagattgaaaaggcgcatgttttgtgtaattatagatacgtcacatgctcacaatctgcttgtcctggtatactggatcaggtgtagtctttgctgcacatggtaaattcatagttcgtcttaagcctttgcccttccagggttttgaagatcagacttctgtatcacttaatttctgattgattttctacaaaaaagtattgtttttaattgtgtgatagtcaaacacagacaaataatattttggttaatcctggactttgtttttattttaatacttggtgacttaatcagaatttagtggggattgactgcactgccattagatacaagtaagaaatgatatgtgtgggatgaaaaccacaagttctcctctgcttgtgcctatcctctgaatttctttaaaagagaaattaatgtaacaataaatttgttgggggagggggcattgattcttattgccctctttgatctttctcttatttcccacagatttgttaccatttcccttttttccctctctcatctcctgccatctcacattgctactggttctacacctcttaaatacaaaataatcaagaaaaaaaaaaagctaagaaaaaattctaactcttgtatccatcataagaaaactcttgtcttccattttatcccctttccttctgatttcgtcatgatagaattgaggaagacggctgtcaatgtaggatttttcttgcaggaggtgagcctggggtaggtagactggaagaagaagagacagaaacagaccaggttcttttagttagggtgactgtacagcctcgtttgcctccagtggtcgcagttgttcttatcataattattaacaatgcttactttcactcccaaaagtgctctgatttggatgataaattatatgtgtatgtttagaagacaaggaaagagaaagattggaagcttaattatttatagtcatttataactctttatcccagcatagtacctttcacaaagcctgacccaagtggtattcagtaagtatgcattgattcatttgaatcccaagtcatacccaaacaaatctgttcattctacacaagtgtatttatatttgatatgttaatatgttctatataatggagaggtaaatctaagtttcaattttagaggacatataccacaagccctataaactaatagaaactgagttcagaacacatacattttttatttaggtaatacaataatttttaaaaaattacaaccaggatttaaaaatcagaaatattcacataaaaatgtcgatttttcagtttcttttagagaaaaaaaaaatgatctaatggcccgagtctgagctcacatggtaattattatatggaatgagcagggtctttattttgccttggcactcaccactctacccatggacattcagatttgcaatccctgatgcatattgtatatttggaagcatttaagatgttaaactttgtatatttagttatctacttaagatgagccaattctcattagtcatgttgtttatcaaagctatttaaatgaaatacttaaaaattcttttggtgataagcctttttaaaaaaattcaacaagttaatcattaatctttgggaaatattttttcccataccatccatgaatggcaacagctattaacaaatatttatattattttattgaataaaaaataagctaacactattttaaatatttttcaacagccagtatcttcgagaaagcgtatttttgaaacatacttatttgagttaaaattgtgaaatgcatttaaaaattgaaattgaaagtagaactactggagaagttttaaatatttgtgagtacatgtatgtgtgtatgtgcatgtatacttatgtgtgtgtatatatatatatatatatatatatatatatgtatgtacataaaatacatagttaacttgttcttcatttggttcttgtttatttatagattggaacagaaagagcaatctccacaagtgtttattaagttcctattatgtgctgtcctgcattttcaattctcaaatgatttatcaactttgaagtacaaagtagtaaaacattctttctacacatgttgaagaaactactgcaagttaaatttggataaatatctcagtatctgatgcatccaggtacttggatgatttctgtgaactatatctgacttctcaccagcaaacatgttttaaaaataatacaaagacggggcacagtggctcacgcctgtaatctcagcactttgggaggtgaggcgggtggatcacctgaggtcaggagtttgagaccagcctggccaacatggtgaaactccatctctactaaaaacagaaaaattagccaggcatggtggcggacgcctgtagtcttagctattcaagaggctgaggcaggtgaatctattgaacccgggaggcggaggttgcagtgagctgagattgtgtcactgcactccagactgggtgacagagactctgtctcaaaaaaaaaaataaaataaaatttaaaatagctacattgcttcaccaatgaagaatttaccctgctaacaatttttagaattttggcaaaaaaatggcttgaataactacattaaatatgaatttaatggcttgaacatattgtctcaggacatgattttatttgtacatttttaaggtttaatatattttcagttaaaattatctatatgtagatcaatttcttgctttcggagtcttttctgaagccttctgatgtcttccagtttgacctctacaccagcaacaagcatcttgacatcttccctcactatcatcttgaggattcatttcatttcttttgttttgtatctcgttctaaattccatggcttcctttttgtttggtctgttgttttggaggattataaactccagtagcttcctgagaaagtaaggggaagtaattttttgagaacttgtgatactttggttggatataaaatgatagaattggccgggcgcggtggctcacgcctatagtcccaggactttgggaggccaaggcgggtggatcacctgaggttgggcgttcgagaccagcctggccaacatggtgaaaccccgtctctactaaagatacaaaaaaattagccaggcctggtggcaggtgcctgtaatcatagctactcgggaggctgaggcagaagaattgcttgaacccgggaggcagagcttgcagtgagccaatatcgcaccattgcaccccagcttgggtgacacagcaagactctgtctaaaaaaaaaaaaaaaaaaaaagatagaatttaaaacaatttccccttcaaagttttacagtaatgtgtcatagcttctagagttgcatttgagtagtccaatgctattctaacttatcatttttatgaaacttgttaattctctgttgattgaatcttctgttattcccattattccaatattttatgataaaatatctttgtgtggctgtattttcaaacattgtgttggacatttcttgggcacttttcagtttagaaagtcatatttttcagtctggaaaatttttttgaattactcttttaatgactttcttccatctgttttctctgtttctttcagaaacttccattttttgaatgttgtgcatcctggacagttctctaattatcttttcatcttttgttttgctgtttttttttttttttttttactttttctttacttttaacctttctgttgagttttttatttctatttttacgctttttaatgtccaaaagttctttttctcttttcttagctttttcccccatagcattcttttcatatttcttaattgcctttcttgctttttttgaagatattactgaaagttttttttttttttctgtctttatagtctttgtttcctttaaatcgctttttctgtttcttttctttggtctctgtctgttacagtagaggctttcattacatttctgatgatccttaagagttgtgtactacaaaactgattggaagggacactgatattacagtttcctctgtgggatgatctggttgggttgattcttagggaaccctggctgtccatatggtgtttcccttgagctggccagtttatcagagaaaacacttttgagtttgctgctttgggcagtatgtataccttagcagctagcattttggaagatggataagaagagtcctcagttactcaaccccctgattcagttactccacccccaattaaaaagtattttaccttccttaccaccaccctccttgagctgcacgaatgccttccagtctggagagactagacccgaagacatctgacaggatggagcaagggtagttgcacaaatctttggaataagagatgagatttcaagatctaattgttttgtaagtagattttcaacaaattcttctgtgtttagtccatccttgtactctactcgtagacatgtaactccggttgcttcttagcttctcactactgctgatttaagattcagctttttgtgcctttatgaaccttcattttgtttctaaatgtacttacttttattttaggtggggtgtcaggaagagagggaagctaataggtagattcactctaacatctttagctgccatctttaacgcatacacacatatatgcactcatatacattaatttcacataaatgctataatcacttaaaaataaggtaataaaatttttaatacttcatttaattagactacatatggttcttgtcaaatctacactagaacagcatttccagtttacatgtattgagataaatcaccaaggctttgcataaattttagaaattctttcttccctaatttctgaattcttcagccttcaagattcaactcagatgtcacctataaagcttttcctgactctcctaagctatagtttattggtcctttctatgtttacctatagactttttaatttaatataccattaaaacatatcacattgtgttataactatgtctaaatcacttactagactgtaagcttccagaaggcaggagtgatgttttgtttgtacagtgcctggcatataatgaatacccaatatatgctttgtggattagtgaacttattatttaaaaaagcaaaccacactttaagtaaataaattaggatatgattattttagaaaatattcactatacaaaataatttacaatgcatttaaaatttcattacatggcttgttttcccctccaggaacatgttcatattagtatcatttttgcatatgtgtgtacatatgtatgcattttccattgttcttctttagtaggggtgttactcgtcttttaaaatacatacgtgttattttgttacatattggcgatattttcccctccagatatcttttgctaggagagcactaagttgctattcatctagttttttgatcagtgcaatatattttaagcaactagttcaaaaatacattcaaatagcatgccctattcctcatgaattgctatttctttgcttaaatttcccactcagaccaccagcaatcccttaagtacttttcctaccagctaatgctagcttttaaaaatctacttaatgtttctcttttctttctctttgttgcctctgtcacttaatatacctgtgtgcctgtctcgatattgttccttctcaaggtctttttatgcttttaggatgatctttcctagtttctttttctactgtcttagatgctttgattctgctgtttctccattgcagagagcttagtggaaggaggaagtgaatattaagagtgtctttttaaaaaaagatgttatgtataatattaaagagaatataaatgctggtggttactatataactagtgctccaaaaaggattttgataaacttttagagtctttcatggaggcaaaaatacgaaaatgcgttgtgtttaaatttcttagacaaggggaaaagggagcattgaaattgggcaattgtaaaaaatgaatgatagatacatgggagttcattattttctatctctatgtttttgtgtatattaaaatctatctaaatacaaggtttaaaagaggttaagtatcatttttcatttcttttgacccaataatcccacttttgggtgtcagtcctctagctcataaagacagatgagcaaggatgttaaatatagcactatttggactggaaaggaacataacttgaaaacagtctgacagctgtacttccattactaatggaattgttggataaattatagtgtgtccatacaatattatatagcaatcaaaaagaatggattgagttatatgctatattctggagggatgtccaagatgtatttttaggtgttgagtaatgcataaaatgtaatttcattttaataaaaagaagctatgaatattgcaaaaagctgtgaaggcatatataccaatttatcaaagttgcttattttaggaaatcggaacttgaaggaatggggtagaagaaaaattaactttattaatctttgtacttaatttgtttcaagtatgtgttacttttggggaaaatgtaatgaagatttgaaaaaaatttaaaaataaaatatttaaaaaatgaatgtcaattcatccaagataataataactcatttttaaagctgtaaagagacacagaaagtgatatgcataagaaactaaatgatgaattagatcataatttgcctttggaaagaaacataaatggattgatagctcatgcctatgaaatgtatattcaactctgattctattcccaaacttctaacagaaattgctgggtaataattagaaaggagactttggccttttatatattaattcagtattctcctaaaatctgtgcctaaactttaagcctttttgttatggtaactgaaccaatcaatttcatagttaaagatgtcccattttcaacagaccatatttaacttggaaccaagggtatctagttatatcagttagggttctttggttgtgagcaacagaaactgagtctagccaacttagacaaaaagaaatgtattggaaagatactaagcaggtaatagaattcatgtttcacctgacagttgggcatttctttttgtgttttagtatgcctctaattatattctctgctttcaattatagcattgctccaaaagttcctaaccaagcgcctttgtcattttgccttaagtcttttttttttaattaccattttttaaaaggggaatttatataacatctgttgttcaaattgtgccctagtaaatgttgagtttggagttataataagtttgatttattataagagatattcctattcagatacttacagatagtttcaacctacatattttattttagaattgtcacccttgagtttctctttaataccaccccagtgtctttgtgtgtgtgtgtgtttagcacatttgttttgtttatcttttttgttgttgttgttttattggtaagttttctggggagattaattgtaaaatgtttattaacattaaattattattatttttgagacaacgtctcactctgttgcccaggctggaatgcagtggcaccatcatggcctactgcatccgcaacttcctggacccaggtgatcctcccacctcagcctcccaagtagctgggactatggaagcgcactaccaggccctgcttgttttttgtatggttttgtaggaacgaggtttctccatgttgcccagccaggctggtctagaactcctgggctcaagcaatccgcccaccacaccacatcttcccaaagtgctgggattacaggcgtgagccattgcgcccagccaaattatttttttatatctatgctattctttataatttctgtctacttaactggaacagtctcttgtgctttttaattggattccagacatcgtgtgtaaaaggacagcagggactaaggtaataagattcatgcccaaaagtggtcatgcctcttctgttaggtcattagtgtaggagattaagtcaatttaggcagtagtgaaactgagtttggttttgttgttgctgtagttatctgcagttgttctggtgggctatcattatcttgtgcttagtttagagcctggggtcttagagagtttttttcaataattttgctcccttcacagctttcagcagactttgcacccctgtatgacagatctctgtgctcctgagcctctctagaagtagactgttaagttggttcaaggcttgtggtagggcctggagggctcattcttggccataccctgtgcacatgagtctcaggggttagacgttttcaatgtttgtgcttctccccagacggcaatacacttttgctttgtattagtgcaggatccttggcatgagtgggttttctcccctttcacagcagcaggtgtcttttgcctagtgtcagggcaaggtaagaatgaggtggagattgtcttggccaagttaac

SEQ ID NO: 1960 - DNA, 1514 bp, Homo sapiens
acaaagtgcctagtggctgattgaattagccacagcacttgtctcctaaaggttcacccaccccttcattctaaatgcattcacggagaactcacggtgtgccgggtactcagatgtcttaatgctagaggaaccatagtgagtacaaagcaggtccggctgcggtgtggcagtgcccagcccgagagggaggtgatgccctgtgctcaaagacaggaaaaaaaaatgctgtaaaaagaattcaaacaggccaggcatgatggctcacacctgtaatcccagcactttttgaggctggggtgggaggatcccttgaacccaggaatttgagactggcctgggcaacatagcaagaccctgtctattgaaaatacaaaaattagccaggtgtggtggtgcacacgtgtagtcccagccactcagaaggctgaggtggcacgttggcttgagcctgggaggttgaggcgcagtgagccgtggtcacgccagtgtaccccagcctgggcgacagagtgagaccttgcttcaaaaaaaaaaaaaaaaaaagaattaaaaatataaagctttttcggctagatgcggtggctcacgcctgtaatcccagcactttgggaggccaaggtgggcggatcacgaggtcaggagttcaagactagactgaccaacatggtgaaaccctgtctctatgaaaaatacaaaaattagctgggcgtggtggcgggcgcctgtaatcccagctatttgggaggctgaggcaggagaattgcttgaacctgggaggtggaggttgcagtgagctattgtgccactgcactccagcctgggtgacagagcaagactctgtcccaaaacaaaaacaaaaaatatttaacttctatgtggaatcaccgtagctagtgtgtgcatgggtatttcattgttaccagaacagtggaaacgctgcatagaactacctcagtggtttatcatctcacctctttgtgtgtgtgtgtgtgtgtgcatgtgagacagagtctcgctctgtcacccaggctggagtgcagtggtgcgatcttggctaactgcaacctctgccttccgggttgaagtgattctcctgcctcagcctcctgagtagctgggattacaggcatgcaccaccacacccggctaatttttgtatttttagcagagacagggtttcgccatgtttgccaggcttgtcttgaactcctggcctcaagtgatccgcccccctcagcctccctgaagcactttcaactgcaagtgcaaaggtcctgaggcagaaagggacatggccttggaggagggtgggggtggctgcaatgtggggaggaacaggcaggtgcagacctggatcttatcctatgtgccttgggcatcgtaccgaagggcttagtccgggaggaggttactgtgtgacatgattcttgcccccaggtcagtctcgatatgctatccatttgtagttctaatattcacaggaaaacccaaatgtaatctcctcattgttc

SEQ ID NO: 1961 - DNA, 11925 bp, Homo sapiens
cagtttttcccctatctagtcacatgtcaacaatgagaaatttaacatttgtggattccgtttcttagctgtaaaatgaatgatctagaggtggattgtccaatacggtagctgctagccatatgtggctatttatatttaattttagctaactaaaactaaataaaatttaaaattcagttcttcaactgcactaatccacacttcaaatgctcagtagccacatgtgactagtagctaccttctcagagaacacagatagttgcagtattgtaaaaagttctactggacatgctggtctagaatacttttaatctttgaccagattatttcagcaaacatcctcctaactctgcacaaatttgaaaggtagggtcagcattctcctcactgccctgtgttgtttcccaactacttctattccacccccagtgacaacccctgttttttccctgccactcaacagtactcagtgattccctcctcaatagctaaagtccttgggacatggcctaatctcactctctactataactctggcctgatccagtgtttataaagactgagaatctcaacacagctgcccatcagatccttgaccaccttgctccactccagctgtccactttatgtatctgggaccttctctccagaaataatacacaattctgaaatattaaattcatgtatctcagtctctgcccacagcctccaatccatccagttatttcattcattgtctcctactacacttgctcctcattttcccaatattttcacatccctgatgttttcacttctttcattaggcagcttttgtcctatggtctaatgcttctaccattctcatgtcaataactttgaagtcttactatatttccaggcctacaatattacctatgcctaagctgcttagactggtagagagtacctcacaaaggcagaccttggtactactaatgataatttatggtcttccactcaatcaggctctcagtgctacccagaagtgcttctatgttttcctaggtagctctctttcccatcttccacaaaggctaatttaagtctcttcttttatcctcaattttgcaaagaaccaaggcccatcacttcacgaagaaaagagaaatcatcacaaggatttgccttcaaatttccacagtcaaatccatacactcacctatagctgtcttttcataattccctctcatgcagtaagagacaatccatctgcttggctctgaacccttagacttcactctacaattagaataaccttcctgcttcttctctatttactttctaccctaagctcaaccaatattactgaatgcatgaaagaaggaatgtgaatgactaaccacctatgataaagtacttcagtatatctttttttttttttttttctgagatggagtcttgccctgtcgcccaggttagagtgcagtggtgtgatctcggttaactgcaacctctgcctcctgggttcaagtgattctcctgcctcagcctcctgagtagctgggattacaggcgcgcgccaccacacccagctaattttttttttttttttgtattttagtagagacagggtttcaccatgttgctcaggctggtctcgaactcctgacctcaaatgatccacctgccttagcctcccaaagtgctgggataacaggcgtgagccaccgcgcccggccttgagtgtatctttaaatgctaattaaatgagtttgtttatttagtagggcagtcatttcatgtaagtatggaaataatctgtgatatattcacacactaggatactaatatagacataaataagttaacaaaactgaactacagtaatatgaacatcacacatatattgatttaaaaaaaacactgaagaatatgattccaatgtattaagttcaagagctggcaaaactaattcatcatagaagtcagaagagtgattatctctggaggaagataaacaaactaggaaggaacatgagtgaaccttgtagggtataggaaatttcatgtgtcattttttaggtgatgattatgtgagtatacaaacacattttaaaaatcatagaatctacacttgaaattggtatacattttataccttatatatgttgtctctcaattaaaataaatattagaatactttcactttctagttcttttgtatatctcatagcgccgaaggtgatatactgtatataaacgctgaagcattccatgttttcaaaaggaattaggcttttgttattttatcctaaaatactgaagttctataagaaaccataagactgaagtcacttaacaacttattctcaccctagattactatgtcttctggctaacacagtaattttaatacaatatactttcattctacaaaaaaaaaaaaaaattaacccaaggacttactatagcagttttcattgaaaagagaatttataaacctactcaacttgctgcatcctttatttttgcatcctttattttaaatagagtcctagtttagttgctgaacacataaaattgcttaatcatggctgaatctgcttctcttttgatcatgatttacctttttattatcatccaatactgtgttcatgctctctatccacaaagtgtcaataggaccatcaaatacaacccatttccggtcaggtgtttctgataaggcaaattctctaaaagtgttagccacaataccatcagtccactgaggaggaaaaaaaagaattaaaaagctctcctcataaaattagatttaggagtaaaactatgaaaatacttcacgtttcttgttttaacaggcactttccataagagagttgggaatacttatatttaggttacctcatgagacactgggtcaaactgtccaaaaagttggcccatagtaatagatttggggtttacagttctataaatgaccttttcttcctctccatagccatgttcattcattaaagttagcgtatccgccagcacatgcagaacttttgtcttagcagcaaaaggctctcctactaacataaaactatgaaggaaaagaaataattatacaataagagtctttaaagagttaaataatttatatcagtatataaaactttaccctgtgataattactacttataatttttgaaatcatatgaatttttctcagacatgaagaaaacatatttaatttctgaactgattgactacaaatcaaattcttcactgtaatattattttctccaaaagggaatataataaacaatctccaaatgacaatgaaaacttattatctgtgtactcttaaaaaaactaaacctgaagcccactaaggagagaactgggaaagatttatattcccaaagtcttcacttgccataaaactattagtgttctttaccaactatttctggatctcctccctcctggcacatataggatttctggccctcttgtggaaagactaggtaactagttctaaccaacgggtaataaatggaaatgatgggcattacttccaagcagggataggtaattgccagctagagacctcacagagctcccttttccctctagcatggccgtgacccacaacgttgaggtggtgcttactctaacagcctgggccctgagtggtcatgacgagcagggctgccctggtaacctactatatataaatgagaaataaatctttgttttttaaatcactaacatttgggtgttgacagttcttacagaatatcctagcccatccttaataacagaagttggtacctagaagagggggggatattcttgccataataataataataaaaaaaacctaatgtggcattggcttaaaggccagattgtgagtgacaaattaactggtatcagaagctaaaatatggacaattattgtcatgcaatgaatgatgaaacatttggtaaatgtattccttgagattacctggaagacagctaattacctaaggaaatgagaattttaggtgaaaaggatagtaaacagaatgttattagtatataatgacaggtactggtttcacttaaaaaagaaccataacaaagaaatgagcccagaaaaaaacatggtcagtttgcaagcaggaatgaaagagggagtccagaaattcagggacttctggaattgaatgtatcaagttattctcattcgcaactggtaaaagataaaattaagaaaacctttaaacaaaaatctattaaaactcagtttggcatcaagtatcaaatcaagggtagggtcattgtatcacattattaaaacctatgaaggattaatatgggccgggtggctcatgcctgtaatcccagcactttgggaggccaaggtgggcagatcacttgaggtcaggagttcaagaccagcttggccaacatggcaaaaccctgtctttactaaaaataccaaaattagctgggcgtgatggcatgtccctgtagtcccagctactcaggaggctgaggcatgagaatcacttgaacccaggaggtggaggttgcagtgagccaagatcttgccactgcattccagcctgggtgatagaccaagactctgtctcccaaaaaaaaaaaaaaaaaaagaatataattcccagtaatcatttcaggagaataaaatgattcatgaaaaacagactaagattgtggctccctccacaaagcctgataaggtcaaggatacttccaggaaattttaaaaggtatggcttattaaggacagtagttacggatataggaacatggagctgtctagaatcaaatagataaaaagctgattgtttttgagggagtttactgaccaaaaaaactgtgagtctagtctaaaacataagtgaatgttcaagacttaaataatccttgggaactaggtgtggtggtgcgcacctgtagtcccagctactcaggaagctcaggagggaggatcacttgagccctggagtttgagaccagcctgggcgatatcaacagactacatctcaaaaatacataataaataatatttaaaataatccttgggtattgaatgcataagggttgattgtactattccctctatttttgtatgtttaaaaatttacataatgtttttgtaaccctacctttagaaaaaatcgtgaccattgagatcccaactttctataggcaagaagcaggctcaaaacatttctcaactctcccaagaacagtattttctctattgcccacttcatatgtgcccagagaagaaaatggaaatggaaagacctctcagaaggttaaactaaggcccaagaagaagaattaaactggaaagcccctctcaggtagcaaaaaccaagcagaagtagattcaggttttaagaaaggtggctctctaagtaaatataaatatatatacacacacacataacttacttatataacatatatataacttttacttatataactataaatacaaaatgtccatagccactttaatgacaccctgtataataaatcacatatacaaaatgcttatggctccttagatgaggcccttcaagtgagaggtcctgaagtttaaactctattagtttcacaatcaatccatctctagaactggggccctcacatgaccagctggatttcagaattgtcacattacagtgttggctgtgtcttctattcttcagtttctgaatgggagtgtttgctctggtaaccctgttctgataagcccactattgtgcactgggtttgtggagaaaagataacttgtctttctaggttgtaggtctctggatcaagaggaacaacttccaggtatgatacaaaggctaccatgcatcgtcacctagggatcctgaactttgagtctggttcatttattgattagaacttttaggtgcctccctgggaagggaagagtgtgtttttatgcaaatggtggtatttattagtactaggtcactgaatgagcacttcttaccaacccttgttggacatgtagtatgagaaataaacctttgccttttaagccactggggggccagggggcgggcgggggttgctctcaactcacctaatcagtttgccaagtctttggttcatggattttagttgttttaccagcttaattaagaaataacatctaactatagcaatatataatcttacccatgtctaacaatcatcatttcatatgtttgaattattttttcaagaaaaaatttaacaggctgaagattatgtacattgcaggcttcatgagcacattccaaaaattcctgaaataaaaaaaagtaatgcatttctacaacacaatattataaatgtcatacctgtcttataagtgtagattttaaatttactagttaaaaaaaaactatcatcattgtttattatttcttaaaactttattattttttcaaatcaagaggagaaacatagactcaaaatacttttaatgtattagtcttccctattgtaagttatgaatgatcatagcatgatagtactgggtgtatgctgcatgaaaataactccttttaatagtgtttcccagaatttcacttttggttaggaaatagaaagacctgtcagacaatcctgcacacttgtagtaaccagaaataaacaaataagttttttaaaattataaaaaatttaaacacatagaagtactttggatgcaaataaatatataaaagaactcagtttcagaaagggatgatgagcctttcctaggtaagcacaaagcaacagctgttttcaccctagggacattttctaagtctggacttggtggatatcggattgggcctgctatagacagaaggacttagccaaagtaggaagaaaccaatagagattttaatggttgtgtgggcttatgtgacagatttgaatttggagaagcccaaatgccaagctggttctcccgaacatccatgcttttgctcagcatgtagtgacacaagagaccaagggcttggctggaaagacacacagagagatttctttagtctcagaatgcttagatcccaaaatcctactacagggaagggccaatcatatggcaggacaattcttactcagaagacatttgaagccagaagtaaactacagctcagtaatgctgcaacaaaactctgacttaggtcaacactcaactgaattgattagcaatgcaacctagctacctgaaatagggaaaaatctcatgatttttctgcaggaaaataataccacctggccaggtgcggtggctcatgcctgtaatcccagcactttgggaggccaaggcgggtggatcacctgaaatcaggagttcaagaccagcccgcccaacatggcaaaatcctatctctactaaacatacaaaaaaatcagccaggcgtggtggcgggcacctgtaatcccagttactcgggaggctgaggcaggagaatcgcttgaacccgggaggtggagcttgcagtgagccaagattgcaccactgcactccagcctgggcaacaagagcgaaacttcgtctcaacaacaaaaaacaaacaaacaaaaacaaaacaaaacaaaacaaaacatcttagcctgtataattattttatacacattgtttaacatacaatcaaaacttaaggttggacgtcctagccagaacaatcaggcaagagaaagaaataaaaggcatccaaatagaaaaagaagaagtcaaactgtcttctctgacaatatgatgctacacctagaaaaccctaaagactctgccaaaaggctcctgaaactgataaatgactatggtaaagtttcaggaacaaaatcaatgtacaaaaatcagtagcatttccacacaccaataacattcaagctgaaagttatatcaagaatgcaatccggccgggcgcggtggcccacgtctgtaatctcagcactttgggaggccgaggtgggtggatcatttgaggtcagaggttcaagaccagcctggccaacatggtgaaaccccatctctactaaaaatacaaaactatctgggcagtagtggcacgcacctgtaatcccagctacttgggaggctgcagtaagcagagattgtgccactgcactccagtctgggcaacagagtgaaactctgtctcagacaaaaaaaaaaaaaaggaaagcaactccatttacaatagacatacacacacacatacacacacacagtaggaatatatctaaccaaagagataaagatctctacaaggagaactacaaaacactgctgaaagaaatcatagatgacacaaatggaaaaacatcccatgctcatggattggaagaatgaatattgttaaaatggccatgctgctcaatgcaatctacggattcaatgctactcctatcaagctaccaagattacttttcacagaactagaaaaaaattattctaaaattcagatggaaccaaaaaggagcctgaatagccaaagcaatcctaagcaaaaagaacaaagccagaggaatcacattacccaacttcaaactataagattacagtaaccaaaactgtatggtactggtacaaaaatagtgacacagaccaatagaatgactagaaacccaaaaataaagctgcacacctacagccacctgatcttcaacaaagtggacaaaagcgatggagaaaagacttcctattcaatccatagtgctaggatggcttgttagccatatatagaagaattattggacccctacctttcaccatatacaaaaattaactcaatatggactgaaaagttaagatctcaaactgtaagaatcctagaagaaaacctaggaatcaccattctggacactggccttgggaaggaatttatgactaagtcctcaaaagcaatcgctacaaaaacaaaaactgacaagtgggacctatttaaactacagagcttctgcatggcaaaagaaactatcaacagaaaaaacaacaacctacagaatgggagaaaatattcacaaattatgcatccagcaaaggtctaatatccagaattgataaggaacttaaacaattgaacaggaaaaaaaaacatttaaaaatgggcaaaggatacgaacagatgcttctcaaaagacatgcaagcagccaacaaatatatgaaaaaatgttcaacatcactaatcgtcagagaaatgcaaatcaaaaatacaatgagataccatctcatacaagtcagaatggctattactaaaaagttaagaacaacagatgctggcaagcctgcagagaaaagggaatactcatatgctgttggtaggaatgcaaattagttcagtcaccgtggaaagcagtttagagatttctcaaaaaacttaaaacagaactaccatttgacccagcaatcccattactgggtatatatccaaaagaaaataaattgttctaccaaagagacacatgcatgcattatgtttaccacagcactattcacaatagcaaagacatggaatcaacctaggtgcccatcaacagtagattgaataaagcaaatgtacatatataccatggaatactatgcagccataaaaaagaacaaaatcatgtcctttgcagcaacatggatatagctggaggccactctcctaagcaaattcacacaggaacaggaaaccaaatactgcatgttctcacttgtaagtggtaggcaaacactgggtactcatgaacataataatggcaacaacagacactggggactactaaggggaagagagagggaggggaacaagggctgaaaaactaactattgggtactatgctcagtacctgggtgatggtatcaataatacctcaaacttcagcatcatgattatgcccatgaaacaaacctgcacatgtaccccttgaatctaaaagttgaaattcctttaaaaataagtaaataggccaggagtggtggctcatgcctgtaatcccagcactttgggaggccaaggtgagtggatgggttgagcccgggagttcaagaccagcctgagcaacataacaagacctcctctctactaaaaatacaaaaaaattagccaggtgtggtggtacattcctgtagtcccagctactcagaaggctgatgtaggaggattgcttgagcccaggagttggaggctgcagtgagccatgattgcactgctgtactccagcctgggtaacagagcaagaccctaactctaaatagtcacttcataacagaaccaaaaaaataatgaagtcatgagaaatagctgatgaccaagagaaaaaacagtaaacaaaacaaactcatagatgacccagatgtcataattaacagataagaacttgacaatacatttacaaagtataaaaagaatagattataagatagaaaaaatagaggaaaaaatatagaattttagcagaaaagagaactctctaaaaagaaccaattggacacactagaactaaaaagatcaaaatatgtgaaattaagaattcattgaatgggcttatcagcaaactggacaaagccaaagaaagaaccactaaccttgaagataggtcaattagaaagtatccaaactacagagagaaagtaatgaaaaacaaaagagaaaaaaagaggcatgagagacacatgaaactatatagaatggtctaatatacatgtcactgaagttccggaaggagagaggagaaaaaattaaggcataaaaacatataaaaagataattactgaatattttctggctgagtacagtggttcatgcctgtaatcacagctctttaggaggctgcttgagcccagagcttgataccaacctgagcaacaaagtaaaaccttgtctctatgaaaaataaaataattagttgggtgtggtggcacgcgcccataatcccagctacttgggaggctgagatgggaggattgcttgagcccaggaggttgacaatgcagtgagctatgatcatgccactgcactccagcctcggcaaaagtgagaccctgtctctaaaaaaagaaaagaaaaagtaaattttctggcaaaacacatcaacacacagattcaagcagcatagcaaatcccaggcaataaagtacaaaacaaaactaggcacatagtcaaactgctcaaaaccaaaaaagaaaaagaaaaaatattaaaacagccagaggagtataaataagaaaaatgcctgacttctaagcacaacactgaaaggcagcagtctatgaaataacatctttaaatgctgggcgcagggtggggtggggaggagacaccttgccaatctagaattctgtatctgtgaaaatattcttcagaaataaagattaaataaagacattttcagacagacaaaaggtgagggaatttgttgccagaagacccatatacacacaaatactaaaggaagttttttaggttaaaaataaaaaatccaaaatgaaaacatatatctgctggaaagaataaaagcactagaaagggtagcgtaagaggcttttttttttcaaatacaatacttaaagcagaaaataataacaatgcattgtggtgtttacaaaatatatagaagtaaaatatatgacaacaatagcacaatgggcaggagtgagtggataatgaaactataccatttaaggtgcttatattttttgtcaactggtaaaatactaactgtaaagttgtaataagccaaggatatatactgcaacctgtggagtgaccactaaggtaaagctataaagccaatagagaagataaaatggagtgataaacattttttgaaatccaaaagaagtcagtaaaacaaatacagaacccattaaaaagcaagatggcaatttagtactatttttccaactggaatctacggatttattgcagtattcataagagtacataagagttcttcaagaa

SEQ ID NO: 1962 - DNA, 11243 bp, Homo sapiens
tagcaacaggctacagatatttcaggtgaaaccacattttttttgttacatcgacaatgtgtaatttaaaaaattattttggggaaagatggaggttttactttttaatagaaaagtttgtatttcaagtacatcagtccttaattgtattctaatctgctaaatgatgcaattgactcctctgtctccctccatgctcctctccacagaatagctctctgtatttttagagaataagactgattctcaacttaagaatataacttattttagttctaagcatttcatttgatatgtaaagtaataagaaatcatagtatagtaaaatttatcaaaataatattttaaatattggcaaatgttttccctctgtattcattattttgtcttccttttgcatccatctctttaagtttccctacttctttgtcctatctcctctgcctgtacaatactcattggatcaggccaaccattcaccatctttttctacactcggattgctgagcgcgtctagagaaagttcacacatccacatggattaatactttgcaaattcatggattcctatgtgaacttcctcctcaggagcatcaagcaattctcttctttgctcctgctctttttcctgtttcccacagtggctgaatagtgtgattagttcttttcatgtcccctttcccacctgcattcttagtaatcaaaaaaaaaaaaaaaagatcagatgcctactgtgtggcttgctcaggagaaatttgatgaagaagtggttcttacctctaagctgctaaaatctgatagagagatagcaagctagagagaaaactgcaagtgcgatgagagctgtgacctaggtatgtgaaattgtgtaatggaaacagatgggctgttagagcagatggagaaggcttcctgaaagaggaagaatctaagctgcatcttgaaggactaattagagttagccaggggaagacggaggggaaaaagaaagttaggcagaatttgcagctcatacaaaggcccggcagagaggaaactagtagggcaatatggggagatgtaaggagtgcagggtggggtcgtgtacctttgggatgcggtactaaagaggatagtggtgaggaacgaggtgacagagtgggcagcgagcaccagtggagggcccggtaggcaataataaggagtctgaattctatcttgagggttggagggttctaagcagggagtgatatgatcatacttgaatttttaaaatagttggttttttaaagatttttagtggtactaatgtagagactggtttggagagaggaagatcaaactgagggcagttttggtagtaaaagcaagaaattgtaaagagggagaccaagcaagtgacacctgtataatgaagaaaattggatggatcatgaatttattaacgaagcagaattgacgggcctgaaacctggtttgagggaaaaagttaaaggtttccaacttgggcatattgacgaaggtagaactacttatcgaaggagggcatgtagtaggaggagtagctttggggcttgtttgagcggatgaccttgttttcaagtttgcagagaaaatttagggcatgtgatgtaaaccaactgattagtcagcaactgggacattatgtgccaagattttacccaggggtgtggttgctaatgtagccaggtattgtggcatgtgcctgtaatcccagctactcaggaggctgaggcaggagaattgcttgaacctgggaggcgaaggttgcagtgagccaagattgcaccactgcactccagcctgggcaagagagcaagactccatctcaaaaaaaaaaacaaaacaacaacaacaaaaaaacccaacaaaacaacaacaacaacaaaaaaaccatctcaaaaaaaaaaaaaaaggcaatgtagggcacatcttttgcctttctgtaccttctgttctgcctgtctctcgaggtgtgagccaaacaggctgtttggcatgcacttcactgggatatgtgacttgaggtcagatttgtagacacaacccttttcaaaatgagatgtactccaaccccctaaaaaaaacaggtgccaaaggctggatgtgtgaaggcagaggtgccttatattgggccttgggtcctgatggtgctctctcatgcaaatttattttggggagttcttgggcaccctgctggcctgttgacaaagctgatactttattcctgttcagctgatgctgtgggtgtttttatgttacttgcaacctgaaggaaaaaaaaggtgagtgattagcatccatcaatagtctttacacattgatgagtttttaaacaccattattttaatgtattctaactttagtgttattgtttatccttccttagtgttcacatagtcccactcttcatagtgaagagtcctatggactcttcattcagtacatttattgaataaccaccatgccaaccaccaaggaatacacaaagtacaaaatatggcacttgccctctaggaactaagagttcattcgagttcacctggtatcttcatgccttcctgatctgggtcctgtaaaatatactaacgtatctgtcagatctgtatttttgtctaagccttgtgaggtctgatgctggatattctccagggctgggaatttagggttctcgggaatatgctgtaccacttacacagagtgctcatatgtcctcacagatgggttacttctgttggcatttgtgctttgaacattgctaatatttagcatcccaaatataggatattcaaatcccaattcaaaaggaaaaattaaaagacatgtgcattaactttggtgatttaagttgttagaattatttcaaatggtgttaaaattggatcttcttttttatagactcttcattgcatgtacagaaaacaggactgaatggattagactaacactttgctcatttgagccctgtaggatagagatggccagtctaaattactgaaaaatcctgaattgtagagttttaaaaatgcagctttattacttttagatgtacttatgggaactcgaaatataggccttctggagaagaagaagaaataattttatataaaatgaatgcttttagaatgcttgaaagcgaactttcctaagtgtttaactttttctctgatagcttggtatcagtataaatttgcttcacaaatccttattttatagctattacttaataaacctcaacctagcttttatcccaatgaaaataaattccactttaattctactgaattaattgtattttagtacaatttaaaaacctttgttacaggccagtttcgatgatctgtggaggaaatttgttacgtattcatctggtgaacaactttttggattgcctgtgactgattatgaggttttacacaaaaccaggtaagtttagaaaataagcaagtattacatgcaaataattaaatactatctattagaagaatcatgtcaccattaaatcctttatcatgcagaggacactacagcttggagcacaactgaatattctccttattccagctattctttacaaattggacacacagtctcctatacaaaagaaacgttctaggggagtaaaaaatatgttgctaaaattttgagcatgcatggtctatatttagcctatgctttactttttcttttgactgtttttgcatagtgtcagtgattatgcagaagcacagcaattttgagtaacttttgtttatttagaggaataaccttcctggctccccttgccttcttttttttttgagacagagtctcgctctgttgcccaggctggagtgcagtggcgcaatctcggctcactgcaagctctgcctcccggattcatgctattctcctgcctcagccttccgaatagctgggactacaggctcctaccaccatggccggctaatttttttgtgtttttagtagagacggggtttcaccatgttagccaggatggtctcgatctcctgacctcgtgatccgcctgcctcggcctcccaaagtgctgggattacaggcgtgagccaccacgcctggctccccttgccttcttactccatttgtggtaaaatgctcttccccattgggtagacatagaatttattgagattgacgtccaaataagctaattgattataaaccacacatataaacaagtgtatttcaatcaaattttagaatattcttaaagaatttgaaatataactttccttaaaagcaacattaatacagtgatagtattagctcattagagtcttggctttagaaaataagtttatgttgacttccttcaaagccacaacgtgaaaatttcatgaaaatagacatgaaattttctgaagagaaatgaatgcttcagccatttagggtaggtggtttgtattctctttctaaaacagtcattctccaaacgtaatccattagccaattgtgttagaattgcggatgtctggccctcatttctgatttactgaatcagaacctctgggattgggtcccagaaaatctgcattttacacactctccaggtgactgtgatgcacactcagcctgagatccaatgcgttcaccctcaggctagcaggagaaatcatcatcaccatttaccatctggaccaacagaccattttcattttgatattttaaattttatgaataattttagagaatggtgagaatggtgagaagctttgaagttttttttttgtttgttttgttttttttttgagacaggatctcactctgttgctagtactggagtgtagtggtggaatcactcgacttccgtagttcaagtgatcctcctgcctcagcctcccaggtagtggggattataggtgcataccactgggcccaggtaatttttaaaaaattttttatacatacaggagtctccttatgttgcccaggctggtcttgaactttggggctcaagtgatcctcccacctcggcctcccattgtgttgagatttcaggtgtgagcacccgcacccaaccgagaagcactttttttttttttgagacggagtttcactcttgttgcccaggctggagtgcaatgacatgatctcggctcacagcaacctccacctgctgggttcaagtgattcgcctgcctcggcctcccgagtagctgggattataggcatgtgccaccatgcccggctaattttatatttttagtagagacggggtttcatcatgttggtcaggctggtctcaaactcctgacctcagatgatctgcctgccttggcctcccaaagtgctgggattacaggtgtgggccaccatgtccggtgaagaagcacttttattagaagatttaataataatttaagcagagtaaactcaaacttttattctgtaatatcctagtttgaagatgtatatatacaaaatggggaccagcactgaatgagactaactcctcatcggctgtcatgtgtgaacctggagcatatccatgctgtaaatatggatttcatattttaaatcatctccaatggatctgtggcttatcattaattctgacttttcttgcacttgcattgtcaagactcaaagctgttgaaaactcggacagtcatcatttttttaagagaagactgtcatctgttttgcttcataaatattgaagactttacttttagatttgaatgatcaattccaagaaattttaaatttctaaatcatctatttccttgaatacacatctgacttcaacatttgtccacttatgaaatgtatcaaatacaacttatgtaaatataaataatgaaggaacactgtcacttatctttttcacaaaatggaatagtttaggttcttgttgcaaaatattgcatgataaggcccttatttctattgaagtctacggaaatatattgtttacttataaattactggattttataaaattcatctaggttatgatcatctgaagacatagtatgagatttcacatattaatcaatttcaccatcaaaagggaatgctgctttctctttcctgtttaatacttgggaaacacatttctttgtcaattttcttctctttacccttttaggtagaaaatgaaaaattctgaattcttaactgtattaaatgaaagcaactgtattaaacaagcaaaaatcaaaagacaacaaaaatggtgtctctggcattctttttatatacttttttgaaagattttgcaatactttatgttatacagtaagaagcctggaggatgatgcagtagtcatttttttttcactgttgcattaccctttaggcaatgtcatcattctcttttcttattttttttagtcatttttagcatagttgagaataataataagtggtaatgaaataattctaagaatgatgaaaaatgaatcaagaattgaaaaaataggacaactaagatcgcagaatgtgtcttagatttgtaaaatctactacgcctacatggtaattacaagatagaatgggctgggtgccgtagctcatgcctataatcccagcacttagggaggctgaggcgggccgatcacctgagatcaggagttcaagaccagcctagctaacatgatgagacctcatctctactaaaaatacaaaaattagccgggcgtggtggcatctgcctgtaatctcagctactcgggaggctgaggcaggggaattgcttgaacccaggaggcagaggttatggtgagccgagatcgtgccactgcactccagcctgggcaacagagtgagattctctctcaaaaataaaataaaataaaataaaaagatagaacgacttttacttcattacaaaatttatttttggtttttgaagtatctctgatgaagaataaaagttgtgaatgtcaatccttataaataaacttgaaaactaaaactgaatccagtagaaccttatggcatactaagggctgaggaatttctgggagaatccacaaattctgttgagtggtcaatttggtgttttacacatttaagaattttcctttacttggaccttttattcttgttttaaacacagtaacttcatctgggcacatgtgggatttttttttttggataggatcttgttctgttgcccaggctggagtgcagtggtgcaatcatagctcactgcatccttgaactcctgggctcaagcagtcctttcacatcagcctcccaagtagctgggactacagtcacatgccaccacacctggccacatgagggaaaacttctggtaggaatagggtgtttaagctcaatcttaaaggcagatcagggcttagtcaagggaaatgttctcataaaatccagcttgtatttgaaagaaaaaaaagtcaaatgaaaccttagccgcagctatgaccttatcattaagttttggtcacattgtttgcaatgattggtatagtaagtttctcattaaaaagtagcaagattttttttctttacagaataaaccatttgctaatgtcaagttatagtctgacttggaatatttgggagcagtaaacttggccttaatgacagatctttaacgaagtctttgtattgaaaatggatatagttgtatgcatttggtatctataagacattgtacacgcaatgtatgaaatatttgattggatgaactctgcctttccaataatggactttattaaatattatacatgatgtgataacttagttactttgtttcccagaaaagaactcaacttgctgcagaagctgtatggattgtatgacaccgtaatgagcagtattagtggttattatgaaatactttggggagatgtagatattgaaaaaattaatgcagaactgctggaatttcaaaacaggtgagtttcaatggaattttttataatgcctgtcttcttaggatcctataggtatttcagaagctaatttattccctaatataatagtgtatatacataaaaccttcctcaaataaatgtgaaggtggcatattttttttctctttctttctgaaagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggtacataagtgtatacgttcttatcaatgatccattaaagaatgtctgctttttcttttctgggagttgtacagatattttatgagaggttggactaattgccctctataatgcaccctcaaaatttggaatgatcctgaacattcttgacttttatgaaataatcttgtaactcaatgagattatatgattatttgaaatacattatttgaaatacatttgttctggaacccttcaatacatcttccttgtccccagaatgcacttccacttaaaaaaaatttgtttatttatgtattgtgttcttggtgaatccctctgaactattttccaaatttctaattttatgctttttcctgttcagtctattaagtttttagaattttctattattacatttttcctttccaagatttttaattcattcttttttgtggccaatctttttttttcattttttcattaaaaattttctgtcccttttgtagattcttagatctacagtcttaaatctatatatattcccagatctgtaggtttcaaatctatagatttatagatgtcttcgcttatctctttgagcattttaaacataattatttaaacatttttcattagggaaaattttaaacacatacaaaagtaaagatctccttgctctagcatttatcaactcatggccaatattattttatctatactatctttatctatacttcaacaactccaaattaaacataaagatgttttcagattcttctttaagattaatttcacctggactgaatttttgctgtgattgttttttatgttggctatcctctgagccttagatttttttcatgggttttgtaatttttattggggtggctgggaggactcattttgaatgggcaggatttcaaaaattctggcttatataatgtgttaaaattgtctctgtccgtttgtgtcttcgttttccttgtctagtggctttgtggttgcctcctacactgtccatgtcccctcagccccaagttgagagccaggtgttgtaatagcggtctccttcctctactgtgctgtggtgtgatgatccaggaatgtgctgacctatttcaggtcctggttgtggggctggttttgtgtcaccccatcccccaggtccacagttccattaaatctagttgcctagatggcagctagaggcagtgttttcagcctccttccatgaatggagggctttagaccccagcccaggtactccttttcctatagatcatttttactcttcttcaccccatgggaaccaaaggcctggccccagtgtccaggcctcaggcctgtgtttcagctccaccaactggtttgcatagcttttccacttttggttcatggatatgtttgtcttttttttaagtctggctctgtttgcttttttacttactttaaaaaaattattttatccattattctatgtttttggagttgagaaaatgcaccatgtgaccagaaatctcccaaatatatggtttgggttttctgccttcccctacctctttttaacaacatgtgtgcacaaaaagcttttctttcaaagcatttttgtcctatttgtaaatatcactaagaaacaaagaggtagaaacactttggtgaccatctccttcttataagtaggtttttatacttaataatatagccattcgtaggctgtgctttattatacaatttcaagtaattccaggcttctgttaatgactcttggtacacaaaacagagtcttggtactgtctaccccagatacatctagttgctcagccacacatgctgtaccattagccaaattagattcctgctgttactggactcactgcctctaaaggaaggcttcccttcagtacagaatttcctcttcctcccagagagtctctgctggaatctcacctcctcctctacgaagctgttcctcctcagcacagacctccctcctcagaaatcaccatggttcacatcattcttaggacatttattacacagtaatttgtgttaagatcatttgtggaaacatctcacacctttaaattctttttcatctctgtgattctaactatgaacacacattgaggcattgtggggaaaatatgttacttttattttctttcgtgagtctttcttattaagtattctcaaaaaaaaaatatagaaaaacccataagaaaaaaacaactgatgcttaagcaaatgagatattcatattaggaccagaacaggcagaaatatagtaatatctatatgttacttgaaagagttcaaaagactcttatgtatattctcatttgaatctcatagctaatctctgggataaacagggcagctgtgattatccccattttagccaaaagttcgaattgaaaacataatctgaaaaatgatgatttaagttccattgtttcatgtatgtggtacagaaaaataattagtagtcggcgattagtaaataattagtaaggctctagtgtcaagttgcaacacaatgatctgaagccttttcttggctgtaaaatgactaaatgaactgggtgacttacaggtccctttcaagcaaaaaaaaaattctatgatttgatgatgcacttaatttgtagttgaaaacatcatgacatatactttgcttttccttcaaaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacaggtaattttataatttgagagagagatttaaatgggatatttagggttataaaattctaagtaaaagctcagttttaaagctctttc

SEQ ID NO: 1963 - DNA, 5603 bp, Homo sapiens
acacctcattccataccagaaacctctaaacctttgttctgtttcaaaaagttaggctggctcgatcagatttccctctagggagtgtggaattgggaaactgtggaccaaatcagcgagcaccaagaacttacagacgtgtgtgctgcagaaaggggcactgactggtgagactggggaatttgagagagtgataagcagggtggcaaccactgtaaaccatggcaaacaaggttatgcaaaagggaagctggaagaaagaaaggaaggcagctggtggggagaggagagggggcagattggcagagagaggtagagactcaaagagagacagacatacagacaggtgactagtgccgcctaaattcctaagatttccaagtcctggccacatgtatcctgtcaataaatttcccctacttttttatagtatcctgaatggcctttgtcctctgactctgttcacataaacatgcgtagcctcaaacaagaagagaggagggatcaggaggctgggggtgcctcctgctgggaaccacagccaccagctaatgccccttttacagtatcttactttgttgtttctccttccaacaactagtctggatataatcaatgtaatccttctctattgttttctccaagtcatgcagagaagctcctctgtaggccttgtcaaagtttttatccacaaagtaaggcacctgcaggttctgagtttctctagaaatggtgtagcccaaggtcctgaaacaaggagagagaggctcatgtgagctcataatatttggcaatattactcttagcactgccctcacagatatcatcatcatcatctgctcatagagcagaggcagatatcattttctaatatacccaacacttcttatttccctagcaaagttgtaagtataacatcatcataattgtattatgtaagcaagttcatactatgaattcagcttcagcatagtttattctcttaaaggactcacctctcttatactgctctctgtgctaaaagtagaatgctgaatgcttaaaacaaacaatttttacgttgtgtaggatctagtatggtacctgacagagtaggctattataaatgctggttgaatgaactgattatgttatatagcaaattatttacaaaaaaaacagatagctcacaccaacctagaagcaatattttggacatgataaaaagtacttcgcacatagctgctaactgagaactgcaagaaactcagacaaaagatttcaatgatgctttagagctaactctctgtgggtccaagacatccaaaggtatctggtgcttagcaacattaataagagtactgagctgactaattctaaccataaggaaacatagaagggacctcaaactcaagttaaaacaatgtgacagaaatggttttcttcaaactggacaaattctacattaaaggggctatattttatttggcctttttccggccctctcctttgatcctctctaattagagtaagagctgaagccatgactgctctcccctcactctaaggttttgggggagcttacagagcaggtccgtgcttaccccgctggcctcacaagaaagaaagctaaagtgccatatggaaaaacatgagaagctgggaaacagagggaatcaggccagtgtggcctgatggcaaaaacctctctatgaaggctaggtgcagtggctcatgacggtaatcccagcactttgggaggccaagaaaggtggaggtcaggcgttcgagaccagcccagccaacatggtgaaacccagtctctactaaaaaatacaaaaattagccaggtgtggtggcacatgcttataatcccagctactcaggaggctgaggcatgagaatcgcttgaacctgggagaaggggattacagtgagccaagattgcaccactgcacttcagcctgggagcctgggtgacagagcaagactgcttcgaaaacaaaaacaataaaaagaaacctctctttcagcctcagcttcgctctctgtaaaaggaaaatactagccgggcgcgatggctcatgcctgtaatcccagcactttgggaggccaaggtgggcagatcacctgaggttaggagtttgagaccagcctggccaacatagtgaaaccctgtctctactaaaatataaaaattatccgggtgtggtggtgcgtgccgcctgtaattccagctactcaggaggctgaggcacatgaattccttgaaccagggatgtggaggttgaagtgagcccagattgcaccactgcactccagcccaggcgacagagtgagactctgtctcaaaaaacaaaaacaaacaaaaaaggaaatactgacctggattgacctggaatgatggtcttgtctacagtgatcactgacaaagactcttcctgttatatattgtctaataaattctacttttaaaaggtttttttcccactaaattataataatgaataataatttattattcattattaacaaaaaagataatctagtgattctcaaacttcagtgtggaccagaataatctagagggttttttaaaactcagacttctggtcctacccccagagcctctaattcaatggatatggaggggccctagaatctgcctttctaacatgttgcctgttgatgctgacgatggctggtctggggaccaaactttgggaactgaatcaactgaaagaattaattgaagaaatttttaaaaatcctatcagagtttataatctatacgcaaaaagcattacaaggaatttctctattttcaacaaaaacaaaaaaattgaaaataatcacttgatccccattattaatactatgctccgagacccacagggtccagcaatcctatcaacagcttaacagagtctttctaactctaccatggtgtgataatgagttcatctaaaccttaaattctactgatccttcaaaaaccagttactgctgttctgcagctgaccagatgatgtcactatagaacaagacaatctatttcccgaggcacacaggagactgcctcagtatttttgagtctcagcaccatgactacccagctgttcctttaaacatcaaatcggtgttttctacagcaaaaggtgaaatgaaatgttagtaatgtatcagcaaaaccttcaagtctttcacccccagactgttactgagaaagatttagaaataccagacttacgatttatagaacagactatatgggggattagtagccagcagctgagtaatgacagatataatcacaatcacaagaactggaagtagctgaataaatgcagaatatgtagtctgaaaaagaaaaaaaaataaaaacttgctgtaagtgttcttttttttttttctgtcgcccaggctggagtgcagtggtgcgatctcggctcactgcaagctccgcctctcgggttcacgccattctcctgcctcagcctcccgagtagctgggactacaggcacccgccaccacgcccggcttagtttttgtatttttagtagagacagggtttcaccgcagccaggatggtctcgatctcctgacctcgtgatctgcccacctcggcctcccagagtgctgggattacaggtgtgagccactgcgcctggcctgtaagtgttctttatcaatataaagcttattgaaaataagatagttgctccaaagaaaataacaaattatcaatgcactgcataggaggatccacaaagccccaggcttttctgggaaggctgtactttcagctgagaagtacaggttgggcagtcctaatcagaaaattcaaaatcacaaatgctccaaaatctagaactttttgagtaccaggatgacacttaaaggaaatgctcattggagcattttggatttcctttttttttttttttctgagacatggtcttgctctgtcacccaggctagagtacagtgacacaaacatggctcactgcagccttgacctcctgggttctgatgattctctcgcctcagcctcctgagaagctgggaccacaggtgcacaccaccgtgtccagctaatttttaaatttttgtagagacaaggtcttgccatgttgcccaggctaatctcaaactcctaggctcaagcaattctcctgcctcagttcccccaaagtgttaggattacaggtgtgagccatagcacccagcctcagattttcagattaggaattgtcaaatatataatggtataatgcaaatttccaaaatccaaaaaaaaaaaaaaatctgaaatctgaaatactactggtccaatttacttcagataagggatactcaatctataccaaataacctttactctctctgctgagcaggctgaaggaggtccaacaacaacctggattgacacccagtaatccccctgcagccccattaataagaccaatgaagcaaacatctctaggtaaacctgcccagactgtgcctcttacagtagtggggctctaggagccaggttagcatcatgcttggccacagctgattggactcaggggacatccaactctggcagaggtaatcacgttttctctcctaggaatttggggttgaaactcatcacccttcacttctgggtcatcactttaaggaagaacacacactctcaggcactgtagactggctatttgcaaggggaagtagaacaagcaaagctgcttggtgaaaacaaaacagaggcaaagagtggcaggaaaactggagacaatctgggcccaaagagtcctgcagagcacagctgcttgggagcctgacagtatcccagttccttgttcctgtctgtcatgaggcccagctgtgcttcttgtccttgagcttcatgagactcttttgatcccttaccttaaaccccctttagttctaaatattttgaagaggattcctattttctgcagccaagaaaattatgaagccggagcggtggctcatgcctgtaatcctagcactttgggaagccaaggcaggaggatcacttgagcccaggagtttgtgaccagcctgggaaacatggtgagaaataatctctacaaaaaatgagctgggcatggtggcacgcacctatagtcccagctacatgagaggctgaggtgggaggattggttgagccctggagtttgaggctgtagtgagctgtgtttctactattgtactccggcctgagtgacagtgagaccctctctcaaaaaaaaaaaaaaaaaaaaaaaaaaaaaaaaagccttgatgaagtcagccccacagattgctgagattctgggagagccacccaagaatgggcagagggaggggataccattctgcctatttaggccaattttccagctcttctaaccattgcttttgctttcctaaagcacatctttcctaaagcaacatatctcaggttcaacttctaaaacttgaccatgtaccatcaaggttggccaagtacaactgtttatgggcagcagtgctcctccctccctaggtacctgaggtttctcttcttcctcctccttctgagtctgtgtcctctcatgtcggtgccgtcgacggtaatagtaagtgt

SEQ ID NO: 1964 - DNA, 231983 bp, Homo sapiens
ctggacaaaacaacttcaatccttaaaaagtcctacccattttagaaacaggtcaatgaagctacctgttatgattgtagaagtcatgtctgcttactgcacctaatttgagaattacagaaaaacatttttaaaaatcacatattattctatcactcagagataaacattgatagtgtttttatagttcccagtcttatttatatatttgccttctttttttgctatttgtttaatttttaaaccaaattcggattacatagcaatgcaattttcccatattattagatataatttttgaaagattttaaaacactaccttatgttccataatttatttaacaatttcactgtttactgacagataatttagagtacttaattattctataaatactataataccaaagtataataatgaatttttgcctgcatctctatttctttaagaaagatttctataaatgagattactagatcaaaaaacattaaaaaattctttttctagggagaatatccccatgcccaattccactacatttgccaactagctgaaaatgatggggttttttttgcatgttttaaattgttatataatggtattagattgcattcttctgaaactcattttcaaaacatctttactcaacatatatttatagttattcttgttactatatgttgtttttactcattctttttttgcttttcgaaaatcgtctcttagttgaataataatatttatgtattagctattggtgaacatgtacgttttcctgaattatcaaaaagatactattgtaagtatgttgtgcacattccccttggcatgtgggccatgggagttgcatgtcttcaactattctggatgatgccacactatattccacagtggctgtaccagtttgctctgtgaatgataatcttcattgctttacaacctctccaacacctagaattgttagatttatttttccctttaattttgacaattggatagatgtaaaaagctatactgtgctgattttagaaggcatttcctgattacttttgcagttgtacattctttcattcattaattgtccatttctgttgcttctccaatttatgtttcttcagaccccttagttatttttctattgatttttatttctgattacttgtttgtattaactctttttatatttcatattaattttctactatgaaacattctgcaaatacaggcataacctgaatgatgttgcctcgattaacattttcatggtaaaatgactcttggtttttaaaatccaaatttcatcatctatttttttttttttgccaatgttcatgtagcaaaactttagatttataataccaaactctgcaaaactttcaataaaaggaaatataggaaaatcatcaagatattttcaaaacatattcagtagaacatcagaataatatatagatattttggaaagcaagctgagtgacaacacacgaaacacccatttcagaagttgctgatgctaaaaggccatcataccatcagtgtgagccacacttggccaccaggcactagagcacatttcccagtgccttccccattttactttttttgcttattgttgaaatccccaaattgttgagaaaacactgaagacaattgtagagaagaaaacaaaacaagtgagaatagctactacgtacaaagcaaacattttataacatgttaattgtagaagtcatcaaggatataatttttttaagtacaagtgatcgaggatataatttttttaagtacaggcataccttgttttactgcactttgtttcattgcacttcacagataatgtggttttacaagttgaaggtttgtggcaactttgcatctagcaagtctattggcaccatttttccaacagcacgtgttcatttcacgtctatgtatcacaatttggtaattctcccaatatttcaaactaattcattattattatgtctgttgtggtgatctgtgatcagtgatcttagatgttcctattgtaagtgttatggagcccaatataagatggtgaactttatcagtaaatgtttgtgtgttctgactgctgcactgactagccatttttccctctcctcaggcttccctattccctgagacacaacaaattgaaattagtccaactaataagcagacaacagcttctaagtgttcaagtgaaaggaagagtcccatgtctctccctgtagatcaaaaattagaaatgattaagcttggcgaggaaggcatgtcaaaagctgagctaggatgaaagctaggcctcttgcaccaaatagccaagttgtgaatgcaaaggaaaagttcttgaaggaaattaaaagtgctactccaatgaacatacaaatgataagaaagtgaaacaggcttgttgaggatatgggaaagtttgagtggtctggatagaagatcaaactagccacaacattcccttaacccaaggcttaaaccagagaaaggccctaactatattcaattctatgaaggctaaaagaggtaaagaagctgcagaagaaaagtttgaagatagcagaggctgattcatgaggttcaaggagagaagccatctccagaacataaaaggcaaagcaggaagtgcttatatagatgctgcagcaagttatccagaagatctagctaagataactaatgaaggtggctacactaaacagcagattttttttttttttttgaaacatagtctcactctgtcactagggctggagtgcaatggtgcgatctcagctcactgcaacctctgcctcccgggttcaagcaattctcctgcctcagcctcccaagtacctgggattacaggtgcccaccactacgccctgctaattttttgtatttttagtagagacatggtttccccatgttggctaggctggtctcgaactcctgacctcattatttgcctgcctcggcctcccacaatgctgggattacaggggtaagccaccacacccggccaaaggcagattttcaagagagatgaaacagccctctgttggaagaagatgccatctaggattttcctagctagagaggagaagtcgatacctggcttcaaatcttcaaagaacaggctgattcttttgttagctgctaacgcagctggtgactttaagttgaagccaatgctcattgaccattctgaaaatgctaaggcccttaagaatgatactacaccaactcttcatgttctctgaaaagaaacaggaaagcctagatgacagtacatctgtttatagtatggtttactgaatattttaagccctctcttgagacctattgctcagaaaaaagattcctttcaaaatattactgctcactgaaaatgtacctggtcacccaagagttctgatggagatgtaaaaggaaatgaatgttgttttcatgcctgccaacacagcatccattctgcagcccatgggtgaaggagtaattttgactttcaagtctcattatttaagaaatacatttgtaagactatacatagtgatttatcagattgatctgggcaaagtaaaatgaaaaccttctggaaaggattcaccatgctggatgtcattgagaacattcatgatttatgggaggacaacaaaatattaacatgaaaaggtgtttgggagaagttgattccaactctcatggatgactttgaggggttcaagacttcagtggaggaaggagctgaagatgtggaagaaatagcgacaactagaatcagaagtaaagcttgaagatgtgactgaattactgtaattttacaataaaacttgaatgagtgaggagttgcttcttacgggtaagcaaagaaaaggatttcttgaggtaaaatctactcctgaagaagatgttatgaacatcgttgaaatgacaacaaaagctttagaatattacataaacttagttgataaagaagggttggagaggattcactcattttgaaaggagttttattgtgggtaaaatgctggcaaacagtgctgtatgcaacagagaagtcattcgtgaaagcaagaagccactgatgttgaaaactttactgttttcttactttaacaaattgccacagccacttctgccctcaacaaccaccagtctgatcagtcggcagccataaatatcaaggcaagaccctccaccagcagaaagattatgacttactgaaggctcaaatgatcaccagtatttttagcaaaaaaaatttttaaattaagataacatatttttttataatgctattgcatactagactactatagactgtaaacacaacttttatattcactgggaaacaaaaaagtttgtgtgccttgttttattgcaatattcactttattgtgatggtctggaagtgaacatgcagtatctctgagatatagatatgcctgcattttaagtctcagtgtgacattattgttctactatggttattttactgtgttttacttacacttcaagaaattcactagagggttggtttgacatataacacattttttcccatttaagtaatggcaaactgtctcaaggaaatcatttttgggtaatacatctgatcatcaggaatcaattagtaacatcaaacaaggggtgtctatatttttttctcagcatgttccttatcttttctttgtttgcttgtttgtttgttttctattttacatgtctcatttaatcctggaaaaatgctataaagtagctagctgattctatcttacagatgagggcactgagattcagagaggtcagtagctggctttattatcttcttcactgtggctgcaataaaaaataaccacaaactttgtggctctcacagctctggaagccagaagcccaaaattaagatgtttaagagcaaagatccctccagaggctctaggagggattccattccttgccactttcagcttctggtggttggtgggactcttgtaatagcatttaggtctcccaaaataatccaggatgatttcctcatctcaagatcctcaatttaatcatatctgcaaggaccattttttttgcaaacaaggtcacattcacaagctctagaaatttgatgtggatacgtttgcagagccaatattcaacttggcacactcaccgaaggccacatagcagaatacggtgtcaagtccagatataggagttccagactccagagttcatgttctttccactccatgtgcggttttccatcacattgtgtgacctgtcgtctccatccctcctcacacctcagattcccttagtcttcccaacctcagagtgaggttaatactctgttctctccgtgccagggtctcttccaaggagagtattcaagagctgtgccacccctttacaaattccattgcgcatccgtgacttcctttccaatacccagacagtttcctgagtctagttcacagactagatcaccaaagcaaccttcctgggagtaaatattacatctttcccattcatattagtttctcaaaagtgctcaagagcctgaagaatgacagaagagaaatgctaaagattgaaggagttcagaacacaatactccaaaatatgttgctctagtatattgactattttgagcttaaagacacttggaaaaacagcagatacaaaaaatatactctgagctttcttcttttccttagaaacaggagataacttgtcctccctacgccagagggaaagtagcgttcttatcatcaaagacgagaagttgatgctgagagaaatctgaacaaacacaccttattaaagtaacccttatcttcctagttacttctctacccaattaacctccctagcccaagcccgttggctttgtcacatactcacaattttctattcctttcccaattcagtacataggtgttcaactttcaactctgtctttgggtttcatttccttaagagggctcttgtgctcacataaaaattgaatgaattaaatttgtatgcttttctcccgctgatctgccttatgtcaattcaatcctcaggcccagctaaaaaaccctaagagagaaaatttggcctcccctacaatgtcatcctctttcttttttctggaccttctatctgctggtacttaagatactaaaatggacgggagaaagaaagcaaaccatgttatgtcttctgcattggcctggtacactccgtttgaaggttactcgaagccagcttgctttttgtcaagagattgcttgatctggagccatatagaaaatggtgacatctccaccccgtgacatatgggccagtaagggcttgcaaagttccattctgcacacttctcttcattctaagaacgagtattcattccatttaaacacatattaccaggaattcaatccaacctctctttttacagtctacctagaattactattatactatttacatacaatatggaaacctcacacatgtatgaatctatttacaaactccctctaaattcaagttgtcattgaaattacatctacctgtattataaatcccataaaaatgatgctatagtttttacttaaacaaacatacatattcttaaaacattaggaggaaaaaattgatttttatatttatcttactatttatgatttctttatttttacataaggatctgagttttcatctattttttcttgtcatcccaaagaacaaagcattttttacagtgtaagttggtctgctggcaataaatattctgtttttgtttttctgaatgcaactttattttgactccgttcctgaagtatgagtatctttggatatggacttcgggattggatagtcatatctccttacagcacattgaagatattgtttcattgtcttcttgctttcatagtttttgaaggtaggttggcagtatttagcagtgcagtttcatgtatatagtgtgttgtttttctccggctattttcaagatagtgtcttgggttttcagcagtttgattacaatgtgcctcagcatcttgaacgtgtacatttatctctcaccaattttgggaagtgtgtggggccactgtttcttcaaatattaggttggcacaaaagtaattgtgggttttgtaatgaaaagtaattgcaaaaccacgattacttttgcaccaacctaatatttttatgacccattctctatcacctttccttctggggaaccaattactcatatgttaaaagaattatcccataggaacctgaggctctggttgctttttttttaatcctttttaaaaatacaatctctgttcttcatagagaaaatctatattgatattatcaaattcactgactgctttggtctgcctgtgtatgtatattccaaaggtcagccagagatttgagcagaatttacaccaaaaatttgtaatgctccttttctggccctctttttaatgacattcctcccttactttccagtagctggggttgctccaaactctgtcccctggttcataaggccagaaagactgagcttcctacaggagtttcagccactctgtgtggccctacctgtggcttgacctcaggataatagtcataagaaatttaacctatactacttccaggtgtcttcaacccccttcgagaatcttgctgcctttgttcattcttcagatccctcagagagttttgttgttgctgctgtttgtgttttgtgagggtttacagactacatgggaagcagaaattgttctttgggatttaacttttacaaaaatcacaagcactcatctcatttgtggcagtgaaagtaatatttacaatgttaacgttaaataacataccttgctacaggtttccagtaaatatcttgtattatgctgcgtaagctcctcctatttctagctcattaaataaatattatttgcttgttggtcttatttaacagaaaaaaaaggagtctctatttattaattcattagttttattttccacagattgattttgttactctcctttaataatgaaagttctcagggctattaattttctgctaaatacagctttagccatttaaaatattgatacatagagttcttactctcctaacagtttattatatagtttcctttcctgtttgaatctggagtttttagaaaaaaatttggtttttgttatcattatttctcttttccaagctactgatttttgcatttaaacttttgctattaatgtctagctctatttcagtgtaggcagaacatggaggctgttaacactttatatttcataatttaatatggtttctttgagatataatatatgatcaatttttttctaaatgcttcatggctccttaaaaaagtgtattgcttatttctagagaacaaaatttaataaatatttattaaatcatctttgttagattattaaaatattctatcaattctgtgtttatttgacccatgaaagatcaataaaagtgtattaaagtgtcatacaacaattctacttccatcaatttttccttatatttctaacagcctttgtttcatgtattttgaggctgttaccaagtcaataaaaattcagaactgccttatcttcattgtgaagtctatcttaaagaaaatataaccttcttgattgcatttaatatttttatagcctttgattctatttcatctaaatattgccaagattacttttttttttaatttcgcttctgcctaataaatcttgtccattctattgttctttcttttttaatctaatgagttactttgttttaggtatatttcttctcagtaccctacagttagattttgctttttagctgaaatatacagttgttgtattttaatagactagtttaataaacatttcacaatgagattcagctttacacaatgctttcacatttatatttcctcttttcaacatatcaggtacaggggaaatgtcattcctatgttatgcataaggaaattcaaagccagataggttagatgcatttcccaaggtcattcaggtaatatatggcagtggcaagacttaaccaaaggatgataatactaagaaaatggctttttacaaacatatactatccccttgctgaacatcaatattcagatagactatttggtcaaattatgttttgtgtttttttttttgtttttttttttagacagagtttcgctcttactgccccagctggaatgcaatggtgcaatctcagctcactgcacccttcacctcctgggttcaagtgattctcccgcctcagcctcttgagtagctgggattacaggcactcaccacaaggccaggctaatttttgtatttttagtagagttggggtttctccatattggccaggctggtctcaaactcctggccccaggtgatccacccacctcagcctcccaaagtgctgggattacaggtgtaagcccctgtgtccggccatggtcaaattatctaatttttcttccactgggggactttatactatttatttttattgccgtaaatgatatgtttgtaacactgtaatcttatttcatgctttgtgtagtttatgctttactcttttttctttgttttatatactattggccctccttgtctgtgggttccacatctgtggattcaaccaatcatggattgaaaatgctcagtgatatggtgtggctctgtgtccccacccaaatctcatcttgtagctcccataattcccttgtgttgtaggagggacttggtggaagacaattgaatcatggggggtgggtctttctcatgctgttctcctgatagtgaataagtctcacaagatctgatggttttaaaaacaggagtttccctgcacaagctctctctttttgcctgctgccatccacataagatgtgacttgctcctccttgcctttcaccttctgccatgattgtgaggcctccccagccacgtggaactgcaagtcaaataaacgtctttgtttgtgaattgcccagtctcaggtatgtctttatcagcagcagtaaaaaggactaatacactcaggaaaaaaaaatggcatctatactgaatatgtacagacattttattgtcattattccctaaacaatacaactatttatatagcatttacactgcattaggtattataagtagtctagagataatttaaagtagtctgtaggttacatgcaaatattatgccattttattccagggacttgagcatccacaaattttggtatctggaagcaatccttcacagataccaagggacgacagtacttggtgatttagatcaggctgcacattcttttctctctccattggtttggaagtcatgcatcctacttttgtttctaatagtggcacctggtatatcaaaaagaatattaatatttgttgaacgaatacattttaaaactttcaaatatttagaatatttgagtctacccctagaaaaatgagaatttgtcacaaatttatttctggaccttgtaaatatgatcctgggtttcttattgcttagtgttaaatattaaggtattaaatatttaatgcttattaaagcattattttgtgtgacatattttctctttcaaaagcatagttttacatttgcattcagtattataattaaagttacaatcacttaaatctcactttttgttaacttggtttaattattaacaaccagccacttctctgttactgaattcttttgttgttgttgtggttgttatttagtttttatttcataatcataaacttaactctgcaatccagctaggcatggaagggaacaaggaaaacatggaacccaaagggaactgcagtgaaagcacaaagattctaggatactgcgagcaaatggggtggaggggtgctcccctgagcaacagaagaaatggtctggtggttaagataaaacacaagtcaaacttattagagctgtccacagtcagcaatagtgaccttcttgctagtcttgccattcctgaacacaaagcgctccatggcctccacaatatccatgccttctttcaccctgccaaagaccacttgcttgccatccaaccacttggtcttggcagggcacatgaaaaactgggaaccatttgcgttgggtccagcatttgccatggacaggatgccaggacctgtatgcttcaggatgaagttctcgtcatcaaatttctccctgtagatggacttgctaccagtgccattatggcatgtgaagtcaccaccctgacatacaaaccctggaataattctgtgaaagcagtaaccctcataatcaaatcctttttctccagtgctcagagcatgaaaattttctgctgtctttggaagcttgtctgcaaacagctcgaaggagacgcagcccaagggctcgctattgacagcaatgtcgaagaaaacagtggggttgaccatagctggtaatacggggctcccagtggcagcaccatctgtgaagtctctgttactgaattcttaacttcaatttctctctcagttacctgggcagtgcttcctaaatgttagtatgtttaagaatctcctagagagactgttaatgcacagattgctacagttcatccagagtcctaactgttctaagcagtaggttttatagcaatattttgtaccatatagtgtggccaaaaaaaaaatatctgattttttgctcctttataaggctaactgttttgtttgcctgtgtgtgtgaaggattttttttactttattctttaaaaaattaccaagttgaaatgatataaaacccttttcattaatgttgcctggagtacggaaagtcccttcaatttttgttttttggtatcgggttttgtttttgtttgttcgttgtgctccgaagagcttttattaatctttcactactatttgtgttctaattgcttctgcctcaagaacatctgtgattcttactttggttctgggtgttcaaatctatgatctctattttctatatttttaatcatctcttttgttattttaatttttattgcacctgttcatttcaacagaaattatcaatttttttcccctcttgattttttctttttcttctttttttttttcttgagacagggtctctgtcatccaggctggagggcaatggcacagccacagctcactgtagcctccacctccccaggctcaggtgatctacccacctcagcctcctaagtagctgggactgcaggtgtgtgccaccacacctggctaatttttgccttttttgaagtgacaggtttacatgttgcccaggctggtctcaaactcctgggcttgagcaatctgcctgcattgtctcccaaagtgctgagattacaggcttgaggtaccacacctggccatgagtgttttttaaatagtgatttcttttcagcttccaacacagacttcaattgtgttatgacattctggtctctttacaatattttcttgactaatccatctccttttccaaataatcctactttttacaatctaaacttattctctcatttcactttctgtttcctgatgctgttgaggatgacaaaaaatcccttcagatttctgtgacatatcatcttgggaggtcaacatttactctgagtctctgagatactgttcccttttccttgtccataatgatttctttttactttagtttatcatgaaagagaccgtgtttgccaagaaaaagatgaagattgtctttatgtgtcacttaaacataaatctcttacagctaaatgacatgttggtttacaaaacttatatcctaatttccatcctctagcaggttttccacctagcatacctgttgggattggcatagactcatcttgtatcactacctgcatctgtattatgaaaaacaacaatccccaaggccctcgtagtttcagcatagatatagtgctttaactgtgacagatcctgacaaacatatttccaaaaatattactgccctatttagtaagcaggataatggtcttccaaaggtgtctacatcctagtccctaaaatctgtgaatgtgttagattacatggcaaaggaaaattaaggtagcagatagaattaagtttgctaatcgtctgaccttaaaacagggagattatcctccagtaccagggtgggaccaatgtaatcacaagggtcattaaatctcaaaaacagaagtagaatagtcagagcaatgcaataggaaaaagagttgactggccattgctgatattgaagatgaaagggggccacaagctaaggaatgcaggcagcttctggaaggtaggaaggacaaggaaacacattttcccttagagacctcagaaaggaattcagcctaacatcttagcccactaatatccatctatttcaaacttctgacctcccaaactgtaaaataataaatctatgtcattttgaacctcaaagtttgtgttaatttattacagcagccacagaaaactaatatatgaccatttatttgagtaaccactatttgcattcttcacatgcatatgcaaaagatgtcttcattaaaagtgatgcttcacaaaagtacttacatgcatagtaattcttgttcacttttctgattagcgtttgcatgtttctgaagcaggggaaagatagcagccaaatgattaaaggtcttccctctgtttggccacagcataagggaatcacctgttgaaattgttcattctagttccaccaaacatctcattagtagaattctctacaagaatcaagactagcttgactataaaaacaaatttttagtggcagcgacttctttttggcatatatcttcttgagtatttttatagaaagttgaaccaggtataatagaggctactactccaatatgaatttaatttcattcattcttcaatcccttcttggataaggtgctgatccacctaagtcactccctcataagtgaatgcaaacttaagaaattataccttcataaaatgggcatatttttctaactgtaaaaatgttttctttaaataggcatgactatggcctgtctattttaatttcgtatagcagtaatttcccttggggaaggagtaaaagacaatattttttaaagtttctctctatctagataggatgctagtagaagcaagatttctatatgttctgatgtgaccaagtagatatttctctactcaccagcctctgaaaatccctgtgtttacccaagatttaactaaagaggctaaactcgtgggtaaatattaagagggaattgacaaaggcatattaagtctaaggagtagactatacttttctaaaataaacacataattacagagttaacacagcagcaccttctgccttgtcagtgctgaaggccccatggcagccagtactcttcacttgacctcgtcctgcaaactttctgtacagcagataaaggcccaaagtacactatagtttagtgaatagcataaactcattcatctgtaagtactagatattacaacatcaggcttctcactggtcctactataaaaataattttatgcttgcacattggacacaattgttctggtggcatagctctttagctacaccagcactgaatagaaagaggcatcctctactattagtctgcaacagaacccagcatttccaccattgcaaacatcaaactggatgaagactttttattcccagcaggattaagtcaaaacatagattgacctaggagaagaagcattagcccttgtcaaataagtataattacttgatgacattggttagtaaagctgcaaagaatactgaggaaattaaaccagctaatttgggaaagaccagaaaggcaatatgaacaccataaaaacatgggtaaggaacagtaagatgctgacctttactgttttctctgggcatgatcctgcctggcagagctatgtttaggctcctcagaaaacccgatgctctctttgcattactagccaatgtgaagcaacattaaataaaaaaaaaaagaaaggaaagaaagaaagaaaacaatcagagaaatgcaaattaaaaccacaatgagatatcacctcacaccagttagaatggcgatcattaaaaagtcaggaaacaataggtgctggagaggatgtggagaaataggaacacttttacattgttggtgggactgtaaactacttcaaccattgtggaagtcagtgtggcgattcctcaaggatctagaactagaaataccatttaacccagccatcccattactgggtatatacccaaaggattataaatattgctgctataaagacacatgcacacatatgtttattgcggcactattcacaatagcaaagacctggaaccaacccaaatgtccatcaatgatagactggattaagaaaatatggcacatatacacaatggaatactatgcagccataaaaaaggatgacttcatgtcctttgtagggacatggatgaagctggaaaccatcattctcagcaaactatggcaaggacaaaaaaccaaacaccacatgttctcactcacaggtgggaactgaacaatgaaaacacttggacacaagaaggggaacatcacacaccggggcctgttgtggggtgtgggggtgggagggatagcattaggagatatacctaatgtaaatgacgggttaatgggtgcagcacaccaacatggcacatgtatacatatgtaacaaacctgcacgttgtgcacatgtaccctagaacttaaagtataataataataaaaaaaagaaaaccattaaaacactttagaaatatataaaggtaggccgggtgctgtggctcactcttgtaatcccagcactatgggaagccaagacaggtgaatcacctaaggtcaggcgttggagaccagcctggccaaaatggcaaaagcccatctctactaaaaatacaaaaatttagccaggtgtggtggcgggtacctgtaatctcagctacttgggaggctgaagcaggagaatcacttaaacccaggaggcaaaggttgcagtgagccgagattgtgccactgcactccagcctgggcgacagagtgagactctgtctcagaaacaacaacaaaaaagaaatatataaatgttttcatttgtatgagaacttatgaaatagtgattaagagaatgggctccaaagtcaaactgtgagggttcagatgctggtcttccccttgtagaaatgttatgtaaattatttatgcttcatttcctacatctgtaaactgggggataatactgttacctcactggctgctttgggaggatcagctgtgataattcatgtaaagcttgtagcagagtgcctaatccctaacaagagttcaacataattgctgctgctgctagggagaggctgcaaagcattctgggtaagaacagggacgctgggacaagattgtagaggctctgccattgacaagctgtaatcttgagcaacgtatttaacttctttgtacctcacttccctcacctacaaaatggaagtaataataaccattatgagggttgttgtgagaattaaagagttaatatttgttaggtgtttagactagtatctgatacatgtctgacaaactattcagctgtacatgaatggttttaaagctgtgattatggaaaaccaagggctttgtacggaggaatggagataaggagagtgtgcagcccagtcccactctgtatgcaaacaaagtaattctagctcttttacatatttaactttcaagcaagattttctttgagtaaagggtaatgctgctttaaaagaagaaaggaaggaaggaaggaaagaaggaaggaaggaaggaaaccatggctctatatgtatgagcctcatataaaatatatcagtacaggtcttacaaaacactgaatgtttttatacacattccctagcagatttaaccagatcagttttaaggttccttctagaaaggaagttctccatacgttgaaaagtgaatttcagtacattcaaattttaaagacacgacttcccatacttcttcagggtaaacaaaaatctcaataattctaatttaacatgcaaaagccatgaatattcactacagtcaaatgaataataaatcacccctgggttcaagtgcttgccatgcaaaattgcctatttcctagaacatccagaaatctgtttttaaattgctttttattacttttgctcttgtgatggttgctcttcaaagcaacttggaaaaatgtgccattctcagcattaaggcgataaaggagaagtgaggacagcagaacacggtgccatccacaaaaggaaagagagtctgtggatcagagggctgggctccggaagacagtttttaaatgtcactagataaaatttatgagataaaagggaatgttccttagtcatcctgagcattgatatctacatgaataataaatcaaaaggctctttatccatttactggtaaacattacgaccttaggttgaagatgtgatttactccactgatatcaacacaacagaaatccagtgaaagtatcactggactggccccaagttctggaaaatcaatgatgcgtgggagaacaaacattttgaggggaagagtatttttttaaaagtaaatatttgtggcactagcaacatgagtgcactcattaagatttcttttaaaggattaccctttagtctctcctacatggaaaactcaagtatactcaagttgtcaattgtataatttgatggaaagttatccctagtattttcccccaaattggattgaattattaatatttcacctttacaaatacatgcagtataattcaatttatataaaatttaaaatatacagaacttacagtgattgcaagtacctaagctggtaataaaggtatcaattaatgaaggaaaatggatatgtcaaaggacaggatagtgactacctctaatatgatcagagagagggttcagatcagggaattttcagaggactgctggggatgctagaaatacaatgtattgacttgggtgaaccttgagataggtgtttatttatagttattcattaaactgttcatacatgtcatatgcacttttcctgtacaaattatatttcacaattttatttaaatagtatgtttcattctgagatgactctccaatctattacatgagacacacttatactcaaaaaggtgttcattctttttctctgaaattcagatttaactgggcatcctgaattttatctggcaattgtaaaccaatcagaatagcatggttagattacaaataatatatatattttaaaagacaggaaaataaaccacagataaaatgcattcttaaaagtcttagtcatttcatttcatattctattaatatgatacatttgtgtttcatggtttctgaccccttgtgtccagcggactataaacataagtatgctacctagacccaaactaatttacttaaaggaaggcaaagaagctgaccattataaatacagcatgccttagaaaggagagtttcaagtcaaaaacaaatctggaaaaaaaattaatttgcttcttttttgtaaagcaatgatgtgtcgtttttatgtgcatttgtttacacagtaaaagaaaagacaatcaaataggtaaaatggatgctgtattgctcccttatacacacaaggaattacacatctgtctaacaatgctaaccactctgagcgataattatggatcaatgctttaaaaaatatcctgaattgcctgcagaaatggcaaggagaatacaattaaattatttgtaaaagccagagtctttttttcctatccatctgctacttgaaatgggatgacctttcaaatagtgcttgctgttctcaatgcaaactctaaataaagaagtggagtgtggctttttttttcctttccaggttcagcatagatacagcatttgtactgacattctacaccactccataagaatgcagatttggcttctagaacataaaagaggcgtttcaggaatataaatcaggcttttgtcccataccttcagtcatgacatttggcttctatcagaaaggtgtgcggcttctgagataagtgtttgagaacaagctacatgaagtaatttactccctggagaaaaattgcaaacctcacccccaaacaaaccgcataaagtaaatgtgttagtgaagaaccttttgttaaactacctatggctggggagctaaatagaaaaggtcagatatttaagctaacaatgggctcaaaacaaaccttccaacaggtctctcaataggcctacattatcaactaacaacttgcactattaagactattaatagtaataagccatgctttcttcactgagtctatatatattttacattgttttattgctcccctaccctttttaatttttaaagcatttccagtttggtcctttgtgtgcttttttaaaaattaggattttggacaaactttcatgtatttttcttaataaaagtgtatcaagcacatttcaaaaagttcaaaaaatacagaaatataaaaaataatctattagcacatcacccagagaaactgacttttaacagtctggtgtttatactcccattcatcttaatacataagcgtatcacaaaattagatgatattatataacaatcaaaactaatcaactgttttatgaacatctttctatgccataagtaacaatctgtatcattatacaaaaattttcattacaccttttaaatgttttatgggtatctctgtgtgtgtatagttgtaaaatataacttttaagtgaatttatttaaatacccaactacttatgagtacatagatttacagctttttccactactgtaaacaaaattgaaatgagcatccatacacacatctttgcagttatttccttagtattactttccagaaatagtatagctggaccagaaagtataaacattattagagccttttggttaatattgtcaatctgccttccagaaagtttactaagcaaggtaggtagatttccctctactgtataatactgagaaatatcaattttttggatacttgtcagtgtgagcaaaaatgtcattattgctctaattattattgctttgataactaatggggctgagagttttactggtgttttataactcttcctttgtgaatcattattcagatacgtttcaaatggtaatttgtaaagtattttgaattttggcccatttttctataagataaaagcattatcgttagtgggtgcagcgcaccagcatggcacatgtatacatatgtaactaacctgcacaatgtgcacatgtaccctaaaacttagagtataataaaaaaaaattaaaaaaaaaagcattatcttaaagtacaacaccattaggatttaagataaatacacacacacacacacacacatacacacatacacacacacaatgagaaaaatcattttaattttaaaaacaatactcagcataacaaattaaacaaaaatgcacacatacgccaggtacagtggttcacacctgtaatcccaacactttgggaggccgaggcaggtggatcatctgaggtcatggagttcaagaccagcctggccaacctggtgaaaaaatacaaaaaaagtagccaggtgtggggtgcatgcctgtaatcccagcttctcaggaggctgaagcaggagaatcgcttgaacccgggaggcagaggttgccatgagccaagatcacgccactgcactccagcctgggcagcagagcgagagtctgtctcaaaaaaaaaaaaaaaatacacaggtatgtatgtatgtggtatataaaataagtcaatacgctatcccagcactatttccaattccattttcccatggcaactaaaaaaaacaaaacaaaaaatagaaacaattacttgtttatccttctacatctttttctagtttcataccagtacatacaaacaggttttgatatagtcattctttgctttctaattccaacggtctcatatcgttccaattagtcaaatgattagatgctgccatatcatggacatgctggacatcacatatagatgtatttagttattattattagttccataatatttcacagtatggttatagtataaatatattcaacaatctcactattcatgtgctgtttttatgttaatgttatttgtcttgatttttttttgccactactaaaaatgcagccatctttaaatatacattttcacatcagagattactgactcccaaaattaaggttgcagagtcaaagagcaagtgtaccattaattttgataaatatatccagatttagcaatatatgaaactcttccatttctaagcacctttaacaagcatggatattatcaatattttccaattttgtcaactacttgactggaaaagtatttatttcattgtgattttaatttgtatttccacaactactagtaaagttgagcagagttgcatgtctcttggtcacttaaattttccctctgtgaattgccaattaatatccctagccatttttctcaaatatggtatataactgtatgtcatcagtgtctaagaattcctatttttctaaaatttatattgtttaatgtacattcatatatttaattcatctgaatttttagatttttattgtaaaaaatagtggtctaacatttacaacttactgatgaaaagccaattttcatagcatcttttattagataaacatacatttcccaactgaactgaaaagacccttttttttttttttttttaagacaggatctccctttgttgtccaggctggagtgcaggggagtgacctcggctcactgcagcctcgacttccctggctctggtgatcctccaacctcagcctccaaagtagctgggactacaggcatgtgccactgtaattgcccagtgggttctccttgcctactgcctagacagagccaatttctcaagacgagggaactgcaatagagaaagagtttaattcacgcagagcaggctgtatgggagacgggagttttattattactcaaatcagtctcccccccaaactcagggatccaaacttttaagaataatgtggtggatagggggtcggaaaggggggagtgctgattggttgggtgggatatgaaatcacagggagtcgaagctgtcctcttttgctgagtcagttcctgggtgggggccacaagaccagatgagtcagtttatccatctaggtggtgccagctgatctatggagtgtagggtctacaaaatagctcaagtactgatcttaggttttccaatagtgatgtttccctgtggagcgatttgggaggtttagaatctcgcagcctccagctgcatgactcctaaaccataatttctaatcttgtagctagtgtgttagtcctataaaggcagtctagtccccagacaggaagggggtttgttttgggaaagggctgttatcatcttttttcaaagttaaactataaactgagttcctcccaaaagttagttcagcctacacccaggaatgaacaaggaaagcttggaggttagaagcaagatggaatcagtaaggtcagatctctttcactgtcataattttctcagttataatttttgccaaggtggtttcgccaccatgccttgctaattttttgtatattttatacagacagggtttcgccatgttgcccaggctggtctctaactcctggggctcaagcactctgcccatcttggcctcccaaaatgctgggattataggcgtgagccactgcatccagctgaaaagacacttttactgaatattaacttcatatatttggatctgtttctcttttttctgtttcatttataaaatgttctcgtggctaacaacataccattttaataacagtaactttatattacattttaatgtttagaagaaaaagtaaaaatgaaacctgttgccattctgataaattatattaacatatctattttataggaatgaatgacattttataataataaaaactattagggaatatgagtatgactcttttgacaggcagttttatctccataacatttttcttttttctatataggccttttttgttaaattgttactaaggattttatattttttgtttccaaagtaatttttttctatttctagataactagttattgaaagtataaagaaaaaatttgatttttatatatttattttgtgatcatccagctaacatgttttcttagtaactgtgtaacagtcataaattctctatgaatataatcatatcacatgacagtgaagagagtatcattttcttcgcttaatttttttgtttgattacaacaagcagaacccataacacagtgctaagtaacagtgctaatagcaaatattcctgtgtattcttcctgatttaatatgagtgacttttatattttactgtttaatgtaatgtttgattataggtctttataaatattccttattgtgtttaacttccttccatgcccattttatttagagtattgctagaaatttctaatacattttatcacatttcttatcagtatgcatactgagttgaatacagtcctccataatttatagtcatgtggaatctcaagtgactttattttgaaactgggtctttgcagatgtaatttgttagattacagtaattagaggtcataagggattagagcggcccctacccaatgactgttgccctcataagaagcaaaaccagagatatagtcagacacgcagagagaataccatgtgataaaggagacagagactggagtaatgtgtctgcatgccaagaaatgccaaggactgttggcagctactaaaaggtaggaaaaggcaagggagggccaccccttagagccttcaaaggcaggatgtccctgctggtaccttgattttgaacctctagctttcaaaactgacagacaataaatgtctgttattttaagccactcattaccaaattaccaaacggtaatttgttatggtggttttaggaaattaacaaagcatatgttgtataatcaaatcatttaatcttttaattaatggtataaagttccaattcagaaccagtttgtaatttttgaaatgaagcctattttaaacattttatcatgttttcataagcagatagatacaagttgctattttttaattatatacttccacatatgaaaatgaaattagcataaaatatctcattagtgttatttatctcaagttttgatataacattttgctagatttgtacagttgagccccattctattttctctatagtcttgaattgtttaagaaccatagggaatatctgttttttaaagctttcgtatgttacaagtatcttttaatcttttaaagtacctgtttttaaatatctagtttacatgtaaaactatctgggcctggtgccttttttctagtggtacatgtttaataattttccactttcttctatgattattggtattaaatgtttttattttgcctatgggaataatataatactgaatgtatatatacttttctaaagaatcatcattttcctagatttgaaagtgaatggctataaaatttttttttaaaaaaaatctagccgtaccagtattgattggcagagttgaccaagggaagctaagagggtacataccatcttcctcccacacgactacatatgcattaaatcagaagacgacagtcttccaagaataaaatgaatcatcaagggaataagagcagttctcatccctagttagaatctctaaacaaaccaaagcaaatgtttttatttgaatcatcaggactgtgtcacaatgaaacctagatggtttgtcttcaagtcatttactactcccctaaagtcttatcaaaagtatgctaaaaaagtttatgacatttccactgagctacaataaagcttctatttttttagatacttgacaaaattttaaaaagaattatttttcccccacacctgcacacattttaaaatatcttcaacttttctacaaaacaattttctctacagctctcccagacttcacaaacatattcttttattcatagcagatggaggaaattagagtaacatatttgctctaaaatcattagtgctgcatcagcacttctgatctaaatgacatttcaaggggttattgttacatagagcaagactttgctccaggcagaaagagacagaaaaacaacttgaaaaatgaacctttttttgcaattagcttctgcatcttaatttgttgaatgccattctatttggattttaaatacaaatcaaaggaagaataaagtgatccaattctgtcagggtcataccttccttactggtcagtcgtctgattaatcattatagctgcttcctaaaaaataatgttgttaaaacttaccatcaactacttgattctctggaaaactaacatattcttacttctcagagatatcttgagaggctgataagtctgctctttagcctcaagaaatgcctaaaattaaactatttaactggtgagcttcacatgactgccactctgtccaagagataaataaacatccctggctgaagaatgaaccaacccataggtgtttctttagcacatactctgttaagtccactgtggaattaaaaaaaaaaaaaaaagtttaaggtactacacacctggaaaatgcaatcttgtaaacataggagaaaccacagagaatgatacaagatagcaacaatcatactttatatttttacactgcattacaattttcaaactactttcatgacacttttcttattttatcctcacagtaaatccataatggaagcaggataaaagaggaaggagacataaacatagaacttcagagatgaaagcaacattaaaggcatcaataaccttctttacagataagaaaatggagaccaaagggaaataagaaccttcaccttgtttcagagtcaggcaagcaaagctaatgaagtgaaggcttgtcaccccaagttgcaaaaagaagtcacaaaaataagacaagaaagagaaagatgatagaaatacaggacactaatttggatttaatgtacttttttaaaaaatagaaaaggaaaagcaattctattgaattcgggtttgaaattcaacgttggtctctagggatcacttggctatggtggttttatgccattaccagatccctttgagaaaaatactattttgaaattcatggtttccagtaaatatgttcaaggctttgaagaacatactcctgtaggtgtaaatggtgtatacacatatacacaaaagcttgaaaacactacttaattactgaacggagtctaaacattctacagctcagttaagaagctacacatgcgtctcacacccaccatctctccagctgtcctccacacaccatcccagcaagtcctagctgaccctcttaatactgtgacctctctgttgtataataaaggttgaaaatcatccttcctttgaataagaatatattataactatattattttttgttacagccttctcaaaaatgtatttcaagccacacataggccattgtcatggcatcttttatttaacagacaatagctattttccatgactcagtccagaatattctttaacatctacatctaggatattatcataattataataagagacggcactacatggatgaagctggaagccatcattctcaggaaactaacacaggaacagaaaaccagacagcgtatgttctcactcataagtgggaattgaacaatgagaacacatggacacagggaggggaacatcacacatcggggcctgttgggggtttggggggcaaggggagggatagcattaggactaatgcatgcggggcttaaaacctagatgacaggttgatgggtgcagcaaaccaccatggcacatgtatacctatgtaacaaacctgcacgttctgcacatgtaacccagaactttaagtaaaaaagaaaagaaaggtgcaaaagtgaaaacattaaaagtggaatcatgattttaaaaaataaattcacagtggtgttgaaagatcatatcagggttagaggacaagtctttgggttagaatgaacacttaatttattatcagagtgaacaataattacctcgacattttaaaacagcattttgtcaccttttaaacgtttgggaacagagaaggcgaaacaccatgtctgacacactatggaaagttttataattctcctcaaaaaggaagaaaaaatatttctatttccattccagatctgcacaatatattcttgcatcccatttggtctgattcatttacattttgctgaattctgtttttgtccattttcatcattcaaaagattttaaaaattcaacaacatcaaaaagccatcaaaagatgctttcagatgaaattgcaaagaaaataagcacatgaattagtgaagcaacttccaagttatacaattgtggcacttacatcttttctcatcttgtccgagaattaattgtactgctgaaattagacatccagcctgctccatgcagacaggagcccaagccggaagaaaactctttgaataacaacactgccttctgattcttttcacatggctacatttttgacatttacttcaatattctacccagttgcagtgtgactatgacaaaatatttctgtaggcatgactggcacctctgcggtaagtggcagggaatggaataggaaacgagtccctttagtagctccaaaaagcccacaggcactctgcaaaccttttgcatacatgctgttaagtaaaggatgtgaaaaatggaaaccgtgatgacaattttaatcaccttacagatgattctatgatctactataactttataatggcaaagccactgacacaggagactgacaggcatatattctctctctgcctctaagtctattaaatgtttatttggggggtttacacatggatagagatgaacttaacagagtatttattgaatctatccacggataaattataaatgactacaactttaactaggtggaattttcatggttatttttaatttctaggcccaaatcacttccctaggctctagaactgtcttccaggagatgtcagatgtcagtaatcagagggaacccatctacagtcaatgcagccaaaagttctgcctacaaggtagcaattagagtccagcagtctcttctggaagtgccaattactgttctgtcttcccttttgaatgcctccttaatataagaataacatatcatttttatcctatcagattagaaaatattgtttaaaataacactcacagttggcaagaatgcagagagagaagcactcccaaacagatgctggtgaggatgtaaattggaatgtcctttctggaaaacagtccagcaaaatttatcatgatgtttttatcttcctgacattagtttgggtatactgttgcatatttttaaatagtcttcaaaagctagagttttaaaactctgtgtggcattttgttacgtgaatacgctatagttttcaattatttccacatttgtcagcattttagttgatttcaacttggggtattataaataatgctccagtgaacatcttcataaatacacatttaactcacattctgtttatttcttagtatagattcaaagtgaaaatacagtggttggcaaggcttatattcaagtataattttatcctagtaattatggaattagtatcagcaaacggattcctaagctagaattcaccatcatttactaggagaaagatctgtggtggtaaaacagactctgcttatttacacagccttactaatgggcaatttgccagaggaatccaaaccagagagcatgtatgattgactaaccattacatggaaagaagaaatcagctcctaccaaaagcacattcatttcaagtaatgccagcaacctgctgagtcagttgtattcagcccctatagaaacccttcccaagttcattgatatgtgacacccatgacatatttttaccatcattggttttcatgaatttgcctgtctttgagacctgaaaaacaatctgatttattgaactgaaaaaggcgaatgtagtgaaaccctatcctgtaattggcaaaccttttacctccctggtggcttgagtagagaagttactggctggaggctgttctaaaggaaaacatgaatggccctaaaattaaaattccagactttaggagccaattaatgaggacataccacttttaatccatcactttgcaatatatttaaaatgttaagactcattgttggcaagggaacagtattccccaaagcttattccatgggaaaatgtttttgtggacaaaagagtttgggaaagagtgatattggaatgaagttcaagctgaacttttaatgtgctattaccaactgtgaatctccatggggggctgtagctagtaacatttgtaaacttcttcaaccacaaattattcctgctttatattgcctttgtttctggcaactgggtttctatagcgcattgcaaggcagagcattctatggaacgtactttagagaatgtttctctaggtcagcagttctcaaacattttggtctcaggatccatttccactcctaaaaactgtggaaggccccaaagagtttgtggttatgttggttatatctatggatatttaccatgttagaaattaaaacagaaaactttcaaaacactatgaatttattttaaaatgacagtaataaccaattacatgtaaatatacatattttcccgaaaaaagagctagtgagaagagtggcattgtctcaacatcacattaatatttagcctaatagaagacaggtggattctcctatctgtttctgcattgtgttgtgatatattattagggttgaagtgtgccaagaaaatctagaaggaatattttaatagccttttcaaataactggattttttctctaatactgcatcaaaacttaacaaatggtagtttctttaaaagttacttgcagagtagaacccgaaaccacatcaagaaatttttagtgctctgttatgtgaaaaatccatggtctgtgtagcattttgaatggatcctttccccatgtgaaattttgtaacagtgcacattgctctggacaaaaatagtggttcattggattatgcagatcttccaaatgttgacacctttcattgcatgatataaaaaagaattatatttgcaatatcatcattgaccttttattagaaaaagtctttaagtattgggaagctgtcaagctcatggtggcatatccaagtttcccaaaatttgaatttttgcttagaagcttgaattttatcactatcaacaaatactggccaacggtttacttaaagcaacagactcactttgtgcattttaaagaaaatatgttaaatacttgagtttgcataattatagtttgtctttcaatgcttctttcatgcagaaaaatagtgttccatataaaaggtagctggttcatttcactacccagtctcacaagtgcttttccttgagacaaccatgatatgtcagtacacagcagcagttctttctgcatacttcccatttcagcacacagaatgctaaaaaaaaaaaaaaaaaaaaactcaacaatcaaaatgcaattaaattaataatttttacttttcaacaaggatattcttagaaaaagttgactttttattttttttaaccatagtgcatggcagtgaaaaatgaaaggccaaaagtacagttcagtgccactgtcttgattcatgctatggtgccagtagttttaaaaaacattacatttggaggagccaagatgtccgaagaggaacagctccggtctacagctcccagagtgagcgacacagaagatgggtgatttctgcatttccatctgaggtacccggttcatctcactagggagtgccagacagtgggcgcaggagagtgggtgcagtgcaccgtgcaccagctgaagcagggcaaggcattgcctcactcgggaagcgcaagggatcagggagttccctttcctgctcaaggaaaggggtgacagacggcacctggaaaatcgggcccctcccacctgaataccacgcttttccgatgggcttaggaaatggcgcaccaggagattatatcccacacctggctcggagggtcctacacccacggagtctcactgattgctagcacagcaatctgagatcaaactgcaaggcggcagcgaggctggggaaggggcgaccgccattgcccaggctcacttaggtaaacaaagcagcctggaagctccaactgggtggagcccatcacagatcaaggaggcctgcctgcctctgtaggctccacctctgggggcagggcacagacaaacaaaaagacagcagtaacctctgcagacttaaatgtccctgactgacagctttgaggagagcagtggttctcccagcatgcagctggagatctgagaatgggcagactgcctcctcaagtgggtccctgacccctgacccccgagcagcctaacagggaggcaccccccagtaggggcagactgacacctcacacggctgggtacttctctgagacaatacttccagaggaactatcagacagcagcattcacagatcacgaaaatccatggttctgcagacaccactgctgatacccacacaaacagggtctggagtggacctctagcaactccaacagacctgcagctgagggtcctgtctgttagaaggaaaactaaaaaacagaaaggacatccacaccaaaaacccatctgtacatcaccatcatcaaagaccaaaagtagataaaaccacaaagatggggaaaaaacaagagcaaaaaaactggaaactctaaaaagcagagcgcctctcctcctccaaaggaacgcagctcctcaccagcaatggaacaaagctggacagagaatgactttgacaagttgagagaagaagtcttcatatgatccaaccactccgagctacaggaggaaattcaaaccaaaggcaaagaagttgaaaactttgaaaaaaatttagacaaatgtataactagaataaccaatacagagaagtgcttaaaggagctgatggagttcaaagccaaggctcgagaactacgtgaagaatgcagaggcctcaggagccaatgtgatcaactggaagaaagggtgtcagtgatggaagatgaaatgaatgaaatgaagtgagaagggaagtttagagaaagaagaataaaaagaaatgaacaaagcctccaagaaatatgggactatgtgaaaagaccaaatctgcatgtttggtgtacctgaaggtgacggggagaatggaaccaagttggaaaacactctgcaggatattatccaggagaacttccacaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagacagaaaggtcgggttacccacaaagggaagcccatcagactaacagctgatctctcggcagaaatactacaagccagaagagactgggggccaatattcaacattcttaaagaaaagaattttcaacccagaatttcatatccagccaaacaaactaagcttcataagtgaaggagaaataaaatcctttacagacaagcaaatgctgagagattttgtcaccaccaggctgccctaaaagagctcctgaaggaagcactgaacatggaaaggaacaaccggtaccagccgctgcaaaatcatgccaaaatgtaaagaccatcgaaactaggaagaaattgcatcaactaacaagcaaaataaccagctaacatcataatgacaggatcaaattcacacataacaatattaactataaatgtaaatggactaaattatccaattaaaagacacagactggcaaactggataaagagtcaagacccatcagtgtgctgtattcaggaaacccatctcacatacagagacacacataggctcaaaataaagggatggaggaagatctaccaagcaaatggaaaacaaaaaaaggcaagggttgcaatcctactctctgataaaacagactttaaaccaacaaagatcaaaagagacaaagaagcccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagttaacaaggatacccaggaattgaactcagctctgcagcaagcggacctaatagacatctacagaactctccaactcaaatcaacagaatatacattcttttcagcaccacaccacacctgttctaaaattgaccacatagttggaagtaaagctctcctcaacaaacgtaaaagaagagaaattataacaaactgtctctcagaccacagtgcaatcaaagtagaactcaggattaagaaactcactcaaaaccgctcaactacatggaaactgaacaacctgttcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcatcactgatcccacagaaatacaaactaccatcagagaatactataaacacctctatgcaaataaactagaaaatctagaagaaatggataaattcctcgacacatacactctcccaagactaaacgaaacgaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaactgaatccagcagcacaacaaaaagcttatccaccatgagcaggtgggcttcatccctgggatgcaaggctggttcaatatacgcaaatcaataaatgtaatccagcatataaacagaaccaaagacaaaaaccatacgattatctcaatagatgcagaaaaggcctttgacaaaattcaacaacccttcatgctaaaaactctcaataaatcaggtattgatgggacatatctcaaaataataagagctatctatgacaaacccacagcaaatatcatactgaatgggcaaaaaccggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgttcctgtttgcagatgacatgattgtatatctagaaaaccccattgcctcagcccaaaatctccttaagctgataagcaacttcagcaaagtctcaggatacaaaatcaatgtacaaaaatcacaagcattcttatacaccaatgacagacaaacagagagccaaatcatgagtgaactcccattcacaactgcttcaaagagaagaaaatacctaggaatccaacttacaagggacgtgaaggacctcttcaaggagaactacaaaccactgctcaatgaaataaaagaggatacaaacaaatggaagaacattccatgctcatgagtaggaagaatcaatagcatgaaaatggccatactgcccaaggtaatttatagattcaatgtcatccccatcaagctaccaatgtctttcttcacggaattggaaaaaactactttaaagttcatatggaaccaaaaaagagcccgcatcgccaagtcaatcctaagccaaaagaacaaagttggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccataggtagaaagctgaaactggatccctttcttacaccttatacaaaaatcaattcaagatggattaaagacttaaacattagacctaaaaccataccatatgaggcactattcgcaatagcaaagacttggaaccaaccaaaatgtccaacaatgatagactggattaagaaattgtggcacatatacaccatggaataccatgcagccgtaaaaaaatgatgagttcatgtcctttgtagggacatggatgaaattggaaatcatcattctcagtaaactatcacaaggacaaaaaaccaaacaccacgtgttctcactcatagatgggaattgaacaatgagaacacatggacgcaggaaggggaacatcacactctggggactgttgtggggtggggggaggggggaggggtagccttaggagatatacctaatgctaaatgatgagttaatgggtgcagcacaccagcatggcacatgtatacatatgtaactaacctgcacattgtgctcatgtaccctaaaacttaaagtataataataataaaaaacaaaacaaaacattacatttgcatcattaatgaaaatattaacatagtgaaaaagaaaaagagcaacttagtattacagtaatatagtttcgaccttgcagactccctggaaggatctcagggatcaccaggagtctgtgaagcaccctttgagcattgtggttctagattcaaaatgtggccttggctgagcacggtggctcatgcctgtaatcccagcacttcgggaggccaaggcaggcggatcacctgaggtcaggagttcgagaccaacattgcaaaaccctgtctttactaaaaatacaaacaaattagccaggtgtggtggtgcatgcctgtaatcccagctactcgggaggctgaggcaggagaatcacttgaacccaggaggcagagtttgcagtttagctgagatcacaccgctacactccagcctgggcaacagagtaagactgtctcaataaaacttacacacacacactcacacacacacacatgcaaaaaacccttagtttaaaacacaaacacatcgtacagctgcacaaaaatattttctttctttatatcctttttctataagcttttttatatttttaaatatttgtattatttttttaaacttttttttgttaaaaactaagaaaaacacaaacattaggttaagcctacacccggatggtatcatcaatatcactgcctcccacctccacatctcatccaactggcaggtcttcaggggcagtaacaggcatgaagttcttacctccaatgaaaacaatgccttcttctgaatacctcctggagttcttgcctgagactgttttatagttaactgttctttaataagtagaagtacatgctaaaataatgataaaaagcacagtagatagttcataaaccagtaacagtcatttgttatcattatcaagtattatgtactgtatgtaattgtatgtgctatacagctggcagcacagtagatttgtttacaccagcatcaccacaagcacgtgagtaattcgtgacgctatgatattagcacactacaatgtcactaggcaataggaactttttagctccattataatcttaagggaccaccctcatatctgcagtctgtcattgaccagaccattgttaagtggcacatgactgtatatacaatggaatactattcagcatttagaaagaaggaaatcttgccatctgcaacacgaatgaacctggggaatgttatgctaagttaaataagccaaacatagaaagacaaatactgcatgatctcacttatatgtagaatctaaaaaagttaaattcatagaagcaggtagtagaaggttggttgccaggggctgtggtgtgggagaggaaaaaaatggggaggtgttggtcaaagggtacaaagtttgagttaagcaagataagtaagttttggagatctattatacagcataataactatagttaataataatttatacttgaaaattggtaagaggttagatcttaaattgctaagagagtagcatttaagatctactctcaccacaaaaatttatgagatgatggatatgttaattagcttgatttcatcatttagcaatgtatacatatatcaaaacatcactttttaccctgtaaatatacacaagttttatttgtcaactataccttaataaaggtggggtgaaaatgcatattcctgaaacccatcatgggcctactcaaacagagtatctgaggaggaggcagggctacccgagcagcagcgcaggttgtacactgcacaccttgcacaaaggtatacagttagcgaagatttgagcttgaagtttgccttttaaagaaattgcatatgtgaatcttggttatagtagaactttaagtgttctagagcagttgttcttcaactttatgtgcatcagaattacctgtcttggggttgaaaacacaaatttctttgtgccatgcttgaactacctaattagaaacctgagcatctgtattttcaaggaactacttagccaactctgccacctaccaaaatgtgacagccatttttctagactaaaaatggtatagctgtctacaagaaatcaactcaacaaaagctgaagacaacacacacacggcttaggatactcaggcatcatttggacagagtctattcaacagctataaatttgttgtttaaaatagccaatgttttttaaaatgcaactttccatagttttctgttgttatatttgttttcattctgtcagtatggtattggatctcaaccttgtatgttatttcaccaacatcttgaaatttatttagccatattttcatggttttatatgaatgcttactaaacatagtctgattttttaaaaggttttatcttatgcaagattcttcaagagaaaagacaaacttagtttactgtcaaattaccaaactgactcagatttttaaaaaccattcgaagtttcatgttatgcacttaacataaaaaaatgactcaatgtaaatgtcatgtctcgtaatgatcctattcctgggatctttcacatgaaacagagtgggcaggaacattctatggctgccaaaatggaattaaacacatggaaacaaagaaacaaaagcacaactcaccccttccagacaacaggaaaacatgtagataaatcagtgattttccttccagctaaccaatgaagtagagacatgtattttaacaattgtaagggcactgggcttaaggaaaggcaaagtaaaaactaggttataatgttcttctagatgcgaaaatgccaaatctgccagtcactcatgaaaagaacacagccccaggcaactgatattgatacattcaaagattatagttatgtatgattacagaatagcatttcataaactctatcagacagaacaactctttaatggaatgttaagagttgggagagagagaaaagttggtcattctaaggtccaattaatttgaaaactcatgagttatatagaattaaacaaatttttttgactgtggaacttctcagagcccttctgtactaatgtgcattacacctctccaagaagaaaaaagcatgcagcatttttcaaacttttgatactttgatgcttttttatttagcttctgactgggctagagttctctgggacacacccagggaaatattgatacagacaggtcaaacaattaaggcaaatgctcaggcatatacctgaactgtggtagaacaatctagatgccacagaaatggtgaaggcatgcccaacagccagccccactatatcaagtcccttagcctctctccattggccttagctctgaaagaaagatgatgcttattagtaaagtgccttgggatggttgggcaagaaacactaaataagaacaaattattaccctcattacagggtagatgatctaataaaccatctctattacttacaaagtttggaggcctgctatttttttccttttaactacactccaatttgaccttaaaaatctatgctaaaaataacttataggaaatatcccaaaaccataccataaactttcttatcggacctctgtctgtttgcacattctcaatgactgccaatcacctacaggtaaatgcaaatttcttagcctgctgtataactctccatctttcaggagctgtagagtttatgattaagatcatggtctttgtagggagacagacaaggttcacatgcaggctccactctactacatctgaagttatttctcttctctaagccctagattatcaaagtatggtccatgaactggcagcgtcagcagcatttggggcttcctagaagggcagaaattcaggctccattgaaaacctactgaatcagaatctacatttcaacaagagcctcacactgtagtttgagaagaactacacaaattctcatacgctttgaccagctcctctgcaaattggaggtaataatagtaaacttggagatggcattcatcgtctactcctttgaatccatcctcaagtcctaaggtccacgcaaatatccttacctgtctctttcccttcattaccttagtccaagctgttctcatttctctccagatctcctgcaatggccactcaactcattacaatgcatctcctcttgcttccttctattctgtttcacttactgcaaccagagagatctcccaggaaaagcaaatgtgatcagagcttccatgagctctcaaaataaaggccaaaagcctttcacagaactacaacctctgttgagggggtcgcttcccacctctatatcttatcttgcatgatgctccacctggtttcctctgctccagaagcactggtaaattcttttttccactccttgaactagccatcctccttcccgatacagaatatttgcaaaaccatcctcctggtcatcagtgccttcccctcaactctttacctggttaactccttctcaatctttagatgtcagctcaaatgtcatctcccctgaaagctttccctgaacctcctacccagcagccaaacacactgcctgacctgttgcctgtgccccataaatatttgttgaataaatgaaggaattaatgaatgttcattcatatggttattgtgacaatcaaatggattgaaacctgtaaatcatttagcacagtgcctggtagagagcaagagcttacttaatgcagtaccaatggtaatatattttgaatattagtcttgctaaaaactagaccccaagcagtacttaacaggggctaacaattagaatcacctgggaaatgttacacttctcaatgtccaggctctgctgcagaccaattaagtcagaatctctaggtggtgggacccatgcacctgaggattttaaaactctacaggagattctaacgtacagccaaagtgtgactgctttactcgttgtctcactgtggtctcccagccttccagagaatagcatactgggcgtcaagaagagtcctcattaatcatggcatgagtctgtggcccacagaaaggggcagtaatatgaatacatgtagtaaaaatctagcaattcatttcccctggctccttgacagcagccagatggtggaaactctccatctattacccaagccagaagaaaacctttctgggaaaatccaagttgcctgaactactgttgggaggaagtatggtaacacgtgaagatgactctggtcctttgggttaagtgatgacttaacaaaattcatcaggattccattataaatctgtcataattgttttgttgaagcaattgctttgtgggagcaattaattcctactgctaaaaaaaaaggtgagaactcctgagtgttccatcaggcaccaagaaataggtgagccgggaagcatttgcccttaccttctgtcttcttcactactcaagtatttggagtgtcaagagaccacactgtacttcaaaggcctcctcttccaaataaccaaccttctgctatgtaaaaacatgattaagaacacacatatttgtactgtatgtctcactcattttgaacttttcaaaatgtgatattgccaaagaagctttatctcttttaagggtttcacacacacacacatacactgccttggtttgaaaaacaacatagaatgcaggcctcatacaatttgagaaccatttacaattataacctaccaagtcagagctgataccaagccaacacaaaggcctcagaattgttataaaaggaacagaattgctctctggaaataatatcccagtgggctaaattccccctccccctgttcctccaaggtggtaaattgcaacaacaacaaaaaagcatgattcatgaatataaatttttcttggcttttaaaatcatacactggcatagtcctccccgaacttcagccaaatgagaatacacagataatgacaattttacaataagtggttccaggacacaggcttttcaagatccacaaatgaaaggcactataaaaaagagtattattattattattatttcaagcacccagaaaaaccacaatcaatgattagccataacaattaaactaacaatagtacatctggaatcagctccatggtaatatgtacttcatgcttaatagttcaaattaattcaatctgatggtgttagacataccagttaggagctggagagcaccaaaattcacattagcttccacttcaaaagatattatgaaaagagaaggaaggaaatgaggctataaacagcagtggtaaatacgaaaggctcagagatgatatggtcaggaataactctcagctattaggaattcagtgatgaaaatatgaaggctgatatttctatccttgcacattcctccagagtcaatgactgagccacccatctgagcgacagaactgaaaccctaaaatcagggcaattatattcaaagaagagggggccttcttcattctgcttacagcatcctttactagtagcccatttatattgcagaatgcatggagaatttctcattttcaggttatagacttcaagtaataagaaaagagagcaggagttggggcaggcataaaaggtgaggtagttattgcctgattaccttatttgtctcactcctccttgaagattcactagataactgtcttaagctgcactataaatattctctaaggcaggatttctcaaccttggcactgtagacactttggcctaggtcattctttgctgtgaagtgctatcctgtgcactgtaggatgtttagaaacatccctagtctccaccttgtagatgctagtagcatcccccacccccagttgtgacaacaaaatgtcttcagacatggccgtatgtcctcttgggggaaaaatcatactggttgaaaactgttaccttaaatcttttttttttttttttttttttttagatggagtcttgctctgttgaccaggctggaatgcagtggaatgcagtggcgcgatctcggctcattgccacctctgcttccaggattcaaatgattctcctgcctcagcctcccaagtaactgagattacaggcaggagccgccacatccagcgaattttttgtagttttagtagagactgggtttcaccacattggcgctggtctcgaactcctgacctcaagtgatttgcccgcctcggcctcccaaagtgctgggattacaggcatgaaccaccgttcctggcctactttaagtcttaattcacttgtttctgggcatcgggaggaaaatccagagggcagactcccctctagactcttcttcctcagagatgagcatggattgtattgccagctgtgtgcaaggcagcactcttcccacggcatgctgaatcctcctcctaacaccttttgcacatataggcttgttgcatataatacagaaatttggaacctggcagtcttctattcattgtgcagaaaagagttaacacagagcaggctcgagaaggcctatccttagaaggcctgtttgcaatgttggcctttggttagcagctgggaattggagctggtaaacagttccctacactaatatgacatttttcctaaattatagagtggccactatgcctcacctgtttgtacaaacagtgtggtttatgctgaacacctgctttccttctgggagtctggaatttgggtatgtgctaggcagatcagctcccagcagtagccttgggcactgagtctctaatgagtgccctagtaggcaacacttcaaacttgttgtcgcagcttgttgcttaaggaactaagagcatcctgtgtgactgcattggaagaggactcttggacgcttactcctgatttctccagactgcacaccatgcaccttttccctatgttgattttactttgtgttctttcactgtagcaaatcagaaccagaagataacaatgctgagtcctaggagtcctcctagagatttacagaaccttgcaagtggtcttggggaccaccaatgcagggactcattcagcattctatttgtgtgcctctatttctagatacagcaaagacttaaactccaagtcctcacagaatttatgtggtagcagcgagcaaagcattaattctagcatatttcaagcttctttcatagaaaacaagccctgtggcatctcttttttgtttttataacagctttttagagatataattcacatatcatactgttaatcaatctaatgtgtacaattcaagatttatattcatagagtcgtgcaaccacgaccacaatcaattttaggacattttcatcaccccacaaagaaaccctatatccatttacagtcactacccattttctcccaaccacccagctaggcaaccactagagtttctgccgctatggatttacctatttttgacacttcacaattggtcatatgatatgtggtcttttgtgagtggcttctttcacttaccaaaatgttttcaaggttcctccatgatgtaacatgtatcagcactacatttatttttattgctgaataatatttcattgcatggatataccacatttcatttatccattcatcagtaaatggaactttgtattgtttctactttttggctactatgaatagtgctactatgaacatttgcatacaatttttttatgcacatatgatttcattccccttgaatagctacctaagtgtggaatttctgggtcatacatatgtttaacttttaggacattttcaaactgttttccaaagtagctgcaccatttacttaccaatggcagtgtaacagagttctaatttctccacatccttgctaatagttactattaactgtctgttttttttttttgttttttttttttttgagacagcctgtcacccaggctggagtgcagtgatgcaatcttgactcactgcaaccaccacctcccaggttcaagcagttctgctgccttagcctcatgagtagctgggattacaggcacgccccaccatgcctggctaatttttgtcattttagttgagatggggtttcaccatgttggccaggctggtctcaaactcctggcctcaagtgatcttcccgcctcagcctcccaaagtgctgggattacaggcatgagccaacgcgcccaaacttatctgtctttttgctaataaccgtcttagtgggtgtgatgtggtatctcgtaatggttttgatttgcacttccctgatggctaatgatgttgagcatcttttcatgggcttattagccatttgcatatcttctttggagaaatgtctattcagacctatttgccccattttaactgggctatttgtctttttattattgatttgtaagaattctttttatattcatattctatctccaagtttcttatcagatatatgatttgcaaaacacttcttccattttgtgggttagttttattatttcaatcatgtcctttaaagcataaaagttttaatttttaggatgtccaatttatccatttttttcttgcattactgtgcttttggcaccgtagctaagaaaccattgcctaacacaaggtcatgaagatttatccctatggttttgtctaataatgttatagttttagcttttccatttaggactttgatactttaaggtaatttttgtatacagtgtgaggtagggggtccaactttattcttttgtgtgtggatatccagttgtctatggcatcttttgcatcactccaagacatagtttcaggtaatttttgtctatacaaattaaggtaacaggtaccaaaacacagaacctatgtatgtgacaaactgcctgaaagcctttataaaaacttttgcaattggtgttctttttttctattttcagaatatgctcagtattttgctatatcaggaagcagtaccaccattattaccactggtgctactgctgctaataataatagtaactagcagatattttgtacttagtatgtgccagacactacacttgcatttaacattcattaacttttaagcactacacatgctttaacttacatgatcttcctgccaacaccacgagataggtagaatcattatcttcattttacagatgatgatattaaggctcactgatgtaaaaaaattttccttaggtcatagaacaagcaggaaaaccgatttaaaaaaattgagggaaggaatggcactggaaagtggaggtcaagtaatgtcggatagcaaattctaacaaacagtagctaagcacgtatgcgaaatatacaaaaataaacaagccaaaatctagcactggtagatgacattcccagttctgatcaagttgctgacaacaaaggattggtctccccttctaactcaacaaagggtaggaaatcttatcactcaagatatcaatcaagatttatttgatcgctgaaagggttttgtcaacactccaaaaattgtattagtgactagatgattgatggaataagtcaattagaaccagattagaaatcgagatatgaagtcaattacttccaatctgaaaattaggaatcattaaacaataatataatagatggcatcaattttcaaaactacccttcgtgtgtttgtctatagggcaaaattcaagtaaaaaataactttgaaaagactaaaactatagagcaacttgatcttgggagtgttttcccagatgggtagtgggctgagtctggtcagttttcagtggagaaaatgtagacgagataagcagttgatgttcccaaattcaaataactttatggcagaaaagtcagtcaagtttaattctctttccctatactagctgtgtccttaatgataaatacaataataatagctgacatgtattgagtcttacattatatagctctctaggtacctaaaagatgacaactaatttatttaaaccaaggcatatgaagtaagtactattattattcccattttatataagaggaaaaggatgtgtaaagtgctaattgacctgcttaagaggtagagtgagaccttgaaccctgtagtctatgtttgtcctcctaatagtgtctctatatggtttcagaatagaagcaaatagacacataagggttaagcatggctaacctaactccaagttgagtctttttacactaggcaatgctgtcttcaatatatttataataactttatacaccaaataacattttgaagtttatttcctcccaatacagaaacatcactgcatttccactgggattttcagtactgtctgttgtggaactgatctgggcttagtgagtattgctttatcattcttaaataaaaaccattatagagaatgcagaaaacaatttccctttcagtttgcccacttctacccataccgagaaagacggatccttaaagctcagaatgtaataaaagctcacaatataataaaagctcagtatcagaaatgttccaagtccctccactctttctctatagttaggaaactaaaatttaatatagggcacaacgctccagagaattcagtgtatcgaaatgttaatacacttttatatattttaactgagataaacaagaaagagatagggaagccagagcagctatggcaaagacataattatgataagactaatccagctaacagcaatagaagcagatagtgactccactgtgatgctgtggtagagtttgtatggtcagaaaactatatcagtatacaatgttaatgacgcaggagccccattataggaaagcaaagataacttactatgtgactctataaagtaaagttcatccaaaagatcaaagagcatttgtcctattactaaaatattatccaaatgtattttatcaattaaaacttggataaaatcatttgcttcattgaacagtaatttaaaaggagcataggctgggcactgtggctcacgcctgtgatcccagcactttcggaggccgaggcgggcggatcacaaggtcaggagatagagaccatcctggctaacatggtgaaaccccatctctactaaaaaatacaaaaaattagctgggcatggtggcgggtgcctgcggtcccagctaatcgggaggctgaggcaggagaatggcgtgaacccgggaggcagagcttgcagtgagccgagatcacgccaccgcactccagcctgggcgacagggcgagactccgtctcaaaaataaataaataaaataaaaggagcatagtatgtccataaccaaataggaaggaaaatgcctattttgattttcataacagagcttaaacattgtggcaaaactttaaaatgcaggacataatgtaaaaattcttctaccagctctaaattcgtggttgtgctatcaactatgtcacatttctcagtgttgaccacaaaaataccatgagatacatacacattgctgaaatacactatttctcaaactcaactttatcttctactccaataaccctgtcaaaaggaaaactagtctggttacttcatttctggcagatccacattaactcctttcttttaatgctcattaatctttctgttaacaatacttctgaccctcaatacccaccctttcagacaggtcaaaactaaattcttcagtttaccatttaagcctttccttcaagtttttgcaggtaaaatgagataaaaacagacgtttgtattccagccagattgaaattttctactaccctctttgctcttcccattaaattctacctcgcagtttgtttgtttttgttttattttgttttgcgtcgtttttttaaaaaaaattgtttattgtttatttactaaatctggggcatattagatacttgaccaatttaaaatttacatcttttaaatcaattttgaagtgttttcacacacacatacacacacacacacacacacacacacaattggcatgcaacagttgtcctaaggtgaaacaatcacctcatcaacaaagtgtcataggtgttctcacccaaggttgcttatcctaaacctgaaaacctgtaacaaatttaaattacttatataaaactcattacttgtagttttccccttgcaaagatctccagaaatgtacaaataactaatatacatcagtcacaacataatcctggatcatccccacatcaaaaccagatgctcctttaattttaaactcattatcagagagcaagagaaagtcatttcgttttacacaaaacaaaattcacatatgccaaaaaagaaagacccaagagaaacaaaaacaaaaaccctagtgctgacactgatgttcagtgccctggttaaacagtggcccgaaggccacggatcaaaaataaaatagcggctgtatatcactgcaatgaagtttaacaggctttaaccttctggcttcagaaatccagatttttccaattacatgaatgcatacttcctacattccaagagtggagaaagtggatgcgccagtgtggaaatgaaaagagccaccattcactgggacaaccacagaactggctttaacagagactccttagaaagttacgcaaaaaataaagacaaaaaatggttgtatgcggcttgtgtcatcaattttaagtggaggtgactgagtcctaaggtacaatgtaaaatgtatgggggaaaataggtgctggggcaagtcttacctttaaaagcaaaacttgaaaacaaagtataaaagtgcccagcctggcagcatacacccaagccagagagctctgccatgagcatgcatagaaaatgtcaggattcatactattgtttctcataaggactcaacaaaatgaatccttaatagcttaaaccacagaatgagggaatacacagaatgcagtcatttcagtaaagtactatcaggctttgtgctgatttcctgaactaactgcattttattatcaaaacaaaaggaaaagaagattttaaaaatatatatatatatatattcctatatttcaattccagtgtttaatttctggaaggacctatataatggaggcagcatttaattaggaaattatgccaatcaattgtcaaattttcactatgactttcctaaaaaggtgttttcttccaatttctattaatcacaaagaaacataagctgtgactgtatagttcagaaaattaaaacatagaaattaatggcctatgacgttatcaccaaggtgtttggtaaacagtaaactatgagtttggaatcatcaggaagaggcttttgaaacaaccctctggacttcaaaaaatctcttcaggtagtagatgtgtcccaatgtcatggcaattagaacaagagcttcaaagaagcaccgaaggaccactgggctgtttgtgttgtcactaatggctctgtgtatcctctcccagattttcgtgtattcctctttgtgctgtacagctgtcatggccacagccagctcactgatcatttcttctagtttgttctggtgagcttctgtttccatgtcttctctttttgtagcctccccaatatcaatggtgaatatcactatctttggagtcatggtggacactcggtcactaaaacaaaatgtatttgttccatccatgtgagcagaaaatgtgtatttcccactggattctttgtctcctttataaatccttttattcttaggtcctgtaatctccatgttgatgcccaggaagccaccttcgaagatgaggcccatcttggtgcctgaggtgactcacttaagcattcttcagcatgtgcgtggatgctgatgaaatagcccaagaccatggtcaggagagtgttctggagcaacagcagctcagcgagcgtcaccacagtggggctggagcagaggccaggactcgcactgcggcctccagagccactgccgccatcaccaccctactgccttcgcctacctggcactttttgctaatcctaggaaaaacgcaaactcaaatgccttttgtgctgggaggtactgtaaataaatgaacagagaagtctagtgttaagaaaaataagacaggccaagtgcagtggctcacgcctgtaatcctagcactttgggaggctgaggcaggtggatcacgaggtcaggagatagagaccatccaggctaacacagtgaaacccagtctctaataaaaatacaaaaaaaaaaaaaaaaaaaaattagcccagcgtggtggcacgcgcccgtaatcccagctacttgcgaggctgaggcaggagaattgcttgaacttggcaggcgaaggttgcagtgagccagggtctcgccactacactccagcctgggtgatagagcgagactctgtctcaaaaataaataaataaataaaaataaaaaataaaaataagacagcagtacgttactggccgaacatatctgagtcatgcgtcatcaaagaatgttaccagcagtgaatctgtatgggtctgcagcaacctcagttcttacctcttcagaagaaagagttcaaccaaggggcataaggcagaaggagacaccaaagcaagttttagagcaggagtgaaagtttattagaaagctttagagctggaatgaaaggaagtaaagtacacttggaggagggccaagtgagtgacttgagagatcgagtgcatggtttgaccttttgacttggggtttcatatattggcatacttccagggtcttgcctcccttctcccctgagtcttcccatggagtgggctgttcacgtgctgggtggcctgcatgcacagtgtgtttactgcagtggtatgcatacccacttgaggcatgcttcccttacctatcaagcgtccctataaggtcatacaccagttaaactccaccattttgcctcttagtgcacatacttgatcccacgcacccacctcctgagatcttattaggaagctgctgatcaccggttttaggtttcttctgtctgttgggagactattgttccctggtgccagctgcaaccaattattatttgagagaaccatcttaacaactgcctgaccatcacctgatggtcgcctgacattcctggtgggatgtggggtgtccctttactgccccaactcatatctgactagctgactagctacctactgtaacaattacacttgattgcatttttttgttgttatttaatttttatttcataatcataaacttaactctgcaatccagctagggaacaaggaaaacatggaacccaaagggaattgcagcgacaatacaaagattctaggatactgcgagcaaatggggtggaggggtagtctcctgagctacagaaggaatggtctggtggttaagagaaaacacaagtcaaacttagtagagctgtccacagtcagcaatggtgatcttcttgctggccttatcattcctggacccaaagtgttccatggcctccatgatattcatgccttcaccatgccaaagaccacatgcttgccatccaaccactgagtcttggcagggcacatgaaaaactgggaaccatttgtgttgggtccagcatttgccatgggcaagatgccagtacctctatgcttcaggatgaagttctcctcatcaaatttctacctgtagatggacttgccaccagtgccatatggcatgtgaagtcaccaccctgacatataaaccctgtaataattctgtgaaagcaggaaccctcacacccaaatcctttctttccagcgctcagagcacgaaagttttctgctgtctttggaacctcgtctgcaaacagctcgaaggagacgcggcccaagggctccgtgtcaatggcaatgtggaagtacacggtggggttgaccatggctgatagtagggtgctcccggcagtggcagcgtctgcaaagactgcttttttttttttttttttttttgacaaagtctcgctctgtcacccaggctggagtgcagcggcacaatctcggctcactgcaatctccaccttccgggttcaagtgattctcctgcctcagtctccggagtagctgggactacagatgcgagctaccacacctggctaatttcttttgtatttttagtagaggcggggttttgccatgttggccaggtctcaaactcctgacctcaggtgatcggcccacctcggcatcccaaagtgctgggattacaggcgtgagccaccacgcctggcctgattgcatatgaaatgcactatttccccatcctatctcacccccatctttttttaacaaagacttctgaaaatgtatttttcatctttcaaactttgctggacaagtttttatgaatagtctcaacagtgcaagcatgatgctagagagcaattaacctttgacttcagtgttgggagactgcagggagaggtgaagactgcgacaaaccactcgtgtatcatggcaatcgctactccctctcagccatttcttgccaactaggaattcaggcagaatgttgtcagatctttcagttattacagaaaagtaagaaaacctgcattttatgtgaaacttccagattttctagtattttctaatttttgcttgaaatcttttattgttccaatatattttatttctatattcctgtgtagcacacatctggttttttatttgtgtggtttttgttttgttttgttttgttttgtttttaggccagtgagctgacagatcgagacctctgggttatgtcattccttggtcagtagctttcagtctttttcaccactacacccacctcaaccaaccatcctttccaccaaccgatgcccatcacttcctttcagatgttgctgaagaaactatttctccatataattttccctagatcactctatccttcattcctcattaccaaactgttttactcttttagcctttagtatgtatgctctgtggtccattggtgagccctttatctttctctaattacacctggactatagatttctaatgccgaggacccttggtctcctgccacattcacattcccttagcagaatgttgcacacccagcagacagtacatgtatactgtgagtaaatattttgtattcctagtcttgctaggatagaagtttttattctatacttgatgcatttctggatcaaaatattaagtctaagtcaagtctccatagttaaggtaatcttgaggattaaaacacttaggtggacaggcaacataaaacactttatctgaataatgaaagaagaatccgtctgttggtctgaagtatcaaagcaactgtcccaatcctacaaactttcagcattgggacttcctttcaagatgtaagcagggatggaaaatatacaatgcaagcgccattgtttcactctcctgggcctgtgacagacatcattaagtgatcacaacgttcttttcttctaaggctgaatgcagtcttagaaaccattttaacatggtatcctagatgtatcgtgtccatcttgtttatttctattaagaaatagagttggcatgagagctgaagatcctatcatatgaaggtacacatacaatttattattcaaaagccagagaacaacatacaactgctgctgcatctcagtctctctatattttaatttatttattgttttgagacagggtcttgctttgtgcaggagtgcaggctggagtgcagtgataccaacacagcttactgcaacctttgccacccaggctcagaaggtcctcccacctcagcccccaagaagctgggaccacaggcatggcaccaccggcatcccgccatgttaccaaggtctcaaacttctgagctcaagcaatccactcatcttggcctcccaaagtcctgggattacaggggtgagccatcccacctggcctcaatctctgtatattttagaggatagataacttcgaatgggaaaagttgtctctaaagttgaccagtcaagaagaaacaatgcttccactttaatgcctatgccagacttaccttacccattaacttttaatcctgtaagaaagatttgctatgtgatgaggctgcttttgttgcaccttgtaaaacatactgaaataaacaaactgtaaatgactttgcagggattgctgatttaaataaataaattgttataattgtagttacagttatagtcaaggggctatttcatttctcagactctgaaccaaagcaattaggaacaactcagacacaaaatgaccagcatcaagaattacaatgaaaagccaattacctttaactataagaaaccttatttgcatttattaaaacaaatgatctctcagtactggagaaaattatgtggattggttgattaacccttcacttgtaagagaccagaaattacttttcagagagcctgtatcttttctaaatttacagacaggaaaccagtaaatgataaatgatcaaggcccaaggaaaaaactgcatagcacaatggacatctatgagtttcacttgtgctagcatgcattcctcattgtgctggtaccatcatcctcactttcctctggggaatccccttctccagttctgactccagatggtgtagatggagctaacttcactccccactgagaatgagcaaatgaccaatcaatgtatttcaccgatgaatgattcagggagccaatcattaattcgagtcagtccagtactactcaatgctaagatttgagaactactgaaggaactattgtgaaagggaagaatttaaaaaaaatcttgctggcattctgagctggtaagataaaaactttgagcgtctagcggccatctaaccactacaaagtgagaccatgcctatgcgtgagaccaacccaatggaaagaaaactaagagatgatagagacatatttctgatgccatctttgagaagctgcatccaatcattctggaggcaaaaagctcttaactttatagataggcaagccaaaatcttcttactttcattaagccacagttagagctaggtttctgtcatttgtaaataaagaagttaagactaaatgcaaatcacttatagcttattttattactaggtactcaatgtctatgcttttgcatagctaagtgagagaacttaaattccaatactgatgggctattacctcatgcaggtaccctaataaatcttgtttcctctcagtgccattgtttcctcatttctaaaatggagattaaaatggtagctcacaaagaagaaatacaaatggcctataatcacatgaaaaaactgttgaacatcattagtcaagaaggaaatgcaaatcagctctacaatgataccacttcacactcactagaatggctatgatcaaaaagatagacaataacaagtgttttctaggctgtggagaaatttgaagtctcatattggcaagtgggattataaaatggtgcttcaaaaagcatctggcagttccttaaaaagttaaacatagagttaccgtgtgacccagcaagtctactcctaggtatatacctctgaggaaataaatatacaagtacacacacacatacaaattaaaaagtccataaccacattattcttaacagccaaaatgtgggaaaaaaaaccttaaatttccatttactaatgaatggataaacaaaatgtgtcatatccacacaatgggcattatttggcaataaaaagaaatgaagttctgttacatctcacaacatggatgagccttgaaaacattatgctatgtgagaaaagctagtcacaaagaccacatatcatatgattccatttatgtgaaatgtccagaataggtaaattcacagagatagcaagtagattggcagtcaccaggacataggaggagaggaaggacagtgactgttaatggctaggggtttcttttcagagtgatgaaaatgttctagaattagatagtggtaatggctactcaactttgtatttatactaaaaccaccaagtttcacattataaacggataaacattgtgctatgtgaattatttcaataagaaaaatatcttatagaaaaaaaatggtagcctattctgattctcacaaatgaccattataagaaatccatgatgataacaatattaaagtgacgttcttgttggagcctaaggaaaaacaatccatacaaatgcaaaggcctattgtttttaaggcctcagcaagtgctaagagaatgggaaaagaaaattaccaaatagattttcccagatcacttagcttcctttgtatccagcaatggtcaacaaatatatagcaggcatacataaaagctattcggagatctcttgaggttaacagcatgcaacatattgccactgcccccagcctggccaggaatattatttatgccaccctttcacagctgtatcaatctcccatgaaacattcagagcctccttgttaataaactacattatgagccggatgcattgtctggataaactgcattgtccaaaacactgccccattattacagaaaatgcagaatgtaattagtattcttctttgcataaactgcagcttccaaaaatggtgccatattataaagccttaattaataaacaagagttgggccatgaccagttacacttatctgaattttatattgtgaagaaaggccactgttcaaattccgtttacaaatatctaaattctggctagcctacatgaagatagtctaaacagaaagcctgagaattctgtgttgctaatagcattgtgttggtacaccaacaatagcaagccattaactgctgggacataaaccatcctgagaaatgttcagagtggaaggatgataacattgtatttcagctgcatcgtatggtgcaattcttctatttgttcatatgcatttcccatttaatagatggaggaaccagggtggcttttcatatctctgtgaaaccttaaatgtgggggagaaaagtgagctggcaaaaaaacaaaaaggataagtacgaggtattgtggggtgggagcagggttacatcacaatggaatgtaagtacacagttgctttctccatttccagctggtttttattgattttcccctaacctaaccccaaagcaaggccatttacataagtcatgagcattgaactaatatttgggaccataatattaagcagcccattttatgaacctcggctaaaggagcatttgcattaaactgcactcacctgattaaaatccatcaactctagcaccttgagaattgtagagtacctgttaagctcggctgtgggactctgcatactgaggcagaccataatcagaaggcagcaaggaatccgaccgggagaggaaagggaggaggagaacatgtgatgtgtgttgaaaagcagatcgcatgaaagaccgccagtgctcaaatctgaaaagagtcctaagcctactgcaaacacagagctgtgcgaacatgataattctttcagcaaagtccataatatggcttatagggccctgtgaaaacaaggtggatgagatagtattacagttcagtgaagagtaactggcccagcaatggaatgtagcatacacaggaggccccaaaatggtccctgcctcagcagaatgagcaagagctcagagagtccaagccgagggactttctgcagcctaaacaagccgtcttagatcactgccctttccatcagctccaggtaccaagcacaggctcagagtcctatctgtctcagaaggacctgctttaccgtgaccgcaaggatggcatttgaatcagtaataggctgtcagaggccaccttgatgcatttgaagaagagctatccctgagacattggttcaagttctcgatctgtaccacctagctgtgtggtcacggacaagcagtcttgctcatctgaccaagtggatgcagataataaacacatgtgaaatgaatgaatgagagaataagacctctgaagcagaatttctctccccagtgatacagacagaagacaaggaaatactgggtagaagagggaggttccctggcaaaggccccaacctcaagcctggagacctgcggcccctaagtggggcatttctgtttttgtacccaaacggttgccttttggcatgccacactcccttatcctgtacccatataaatcccggaccccaggctccaggagcagacaaggagaagaggagaaaagcagacaaatgacacaacagagaaagagagaggagaaggaatgtctgaacgccgagaggaactcagctgggggcagtcggagaagagtttggccgctgaacagccaaaactccaggggaagatcatcttcccattccatcccccagccagctccccatccatcccattgagagccacctccaccactgaataaaacccctgcatgcatccttcaagcctgtgtgtgacccaattcttctaggatgctggacaagagcttgggatacagaaagctgtcacactggccctctgcccttgcagaaaggcagagggagcactgagctggttaacacttaagctatctgtgaatggcagagctaaaagagcattgtaacactggggccacaggcacccacccctagacactaccatgggactggagcccaaagcactcactcttgctcctgcacctggccatctgtgtgctccctctcccacaaggggtttgagttcatggtggttgaacagagagccgcacccctgtcgcatgccccatgagtggggccagggaactcttctgtttcatcaacactattgacatttgaggtgggatgattctttactggggaggctgtcctgtgcattgcaggatgttcatccctggcctctacctacaagatggtagtagcacacatactccctcaattataacaaccaaaaagtctccagacattgccatatgtctctcaagagccaaaattattcccagttgagaatctctaatttatccttcagaatgtacattccaggatctaaattaatgagccatacacccagatagtgccccctaattattaggaaaacttacatagataccttcattatcactggaaattcatcaagacaaaaattttactgagcacctattatctgccatgtagaaagatactgttcctgctcctgagaagctcacaagtttaagtggaaagtggcattttacaacttcacatcaaagaaaagagaaatgttcaggtaaccatctttccaataaataatagaatatccttctatctgattagagaggtgaactgtaaagacaggcaagaatcagagcatatctctttgctattaaaagaatactacatgtatcaaagttgctgacatttgataaggtgaatttttggtaattttgactcattttagatgtttgctgcagttgtttattgctgggtgcagggagtctcagactcaaaggacaatcttatgaggtggtttagcctaagagcataagccaaaagagagagctctggaatgaaactgcctggttttaaatctagattctgccatttgcttgttacgtgacccctggcaattcattaaccccttcaatcctcaaatccttctctatgaaaaggagataatcaatgtacctacctcacggatttgttaaaagggttaaataacttatgtaaagtgctgaacacaatgcctcccacaaagcaaaaattgtaagaacaatagctgttagcattgttatattgatattgctgcctctccattttattatgatcttttttattgtagtaaaatacatgtaatataaaatgtgccatttcaatcatctttaagtctacagttcagtggcattaggtacattcatattattttgcaaccattaccatcatccatctctagaacatcttttattttccccagttgaaatttcccattcctccctccaccagggttgttctcttaaaccagtccttacccagcaaaataccttctaaggaaatgaggacaaagcttttgtaaatgagactaaaggcaattcaaactcaggtaccctggaaactgaatagaggtagtgcttaaaatggccatttgggccacttggggttatgttgatgagtttagtcaccatgaaccaactcctaggagtaacattctaagtgggtttttgttttgttttgttttttgttttgaggcaaatggttcctggctctgtggccttcccatcttaccatcacagaagcattcactctactcctctaatcaatattaacccagaaaaaaagtccagggacatatatattttggtagcctagaattaatgggaaaagacaagttgctgggtctaaactatcaaagtcacgtactttttaacagagaatgaacaaacctcctcccttcaagaatccacctgtttttgcaagagcattctggggtgggaggaaaaccttctgatttctagccagctcctcaaaatagctaaagagttcctaatttcacctcaaacctctgtttcagcacctactgtgttgtgccaagttatttctcatccactatcatttttgacagtggatctgaccctattgcaatcgagtttaaggagtttgtagacaggaaccctatctgagctgtcagcacgttgcctgatcatcttcagcaagtggtctggcagaagcatgcaggtaaggatgccctgaagcaggctgtcaagaaaactgaccaatgagaaaggtgttttgtgctccacagctgaagccaattctgctgggacatcccaagacagactccactcggactcaactgataatacacactttacatctgtcactatctgcccaggcatattgactttgtaacattccccccaggcacttcaagtccagtttcgactctgtgacttttgcctgtggtcactttgcctgaaatgccctttctccttctccttcttatccattcattaggatctagcaaaatgtacctcctttgaaaagcactttctgtagccctcaggcacaagtggggatggctgtgttggaccagaaaaagcaaccattgaaatttccaaactgaatctgtactttgatttatttcagtgtggtataatgtatggtataatatatggcaatgttttccaagtctgactgtacatcacagtgacctgggggacttttgaaaaatagattcccaggctcccctccaattaagacagcaggtcagaaggttgcaactcaggaagctttacttaatgtctagaagtttcccaggatattctgatgcatgaaccgtacttgaaacaatagtcagacattgctacttatcagctgtgtgatttggggcactctgagcttgtttcctcatctgtaaaatagcggggaagtaggggagtgtcacaaggtcttagaaaggaccacatgagggaatgagtgcaaaattcttaaatgatgcctcagtaagtgaaattatgatgctaattacaacgaatgtccttaaaaagctacttttcacttccaatagtccagcttgcaaaaccttcctctatcagagaaaaatttagtgaaagagtaaatgggcttcacaccaggatgatagcctggaaaaatcaaaagagacattgagacattgcccacatagaaagcaggggaagagcatgttcagtttttctgaaggtctatattcttcattcctactgtccatttctcctgattaaaagtctctcccaatagctgagaccattaacaaatataagcccatcaaatggtagctaccccactttgtaaaattaggcttttgtgtctctcatagaataatgttctaacacttcactacctgtaataaagtatttgcaccacaagaaaaaaatgtatttcatgaccagcaggctacaaccagcattctgcttttaggaacccatgcgtttgattgtatcctaagttggtaatgagtcaccacttttgcatttagttaaggacaccaaacaatgactctgtgaacctcagctcagactgcccctgagtcctcagaagatgcctaaatatggactgttctgtagcgcttaaggatatcaaatgacagtataccatgacaatcacaactaatcgaagtcccctgcagagtagttcctcataaagagatggagatggaaaagtaggaacgtttttcaatgctatgcagaaggaaaataatacctactgaccatattcatcctttcaaaggtctgccctgaaggcaagttgacaacacccaggcttggttctcccttttggaagagctaacgctaggagagttcacccttgctccctctggcgggaatcagcagaacagagcgggaggcactgtggcattaggattgcaaaccctggcttcggacacagtgctgcttgaatcagaatctacactgcagctgggcaactggctgaggtcacatttttaggctctgagctgctttctctatttgcaaagtgagaatacacagcttctaaggtcataatgcagatcaaattatatataaagcacttaacatgtgctcagtaaaaagtcattgatctaattattgttgtactttattgtcattaatatcaagggaatgacagcatagtgagtctcctagggatgcaggtcaatagatgttgaactgctattatgcagcaggtactgtgctaggtcctgggtaataccagagcaaacaagatcaacacaatctgcacctccaggaagcttatggtctagttcagaggtaggaaaaatgtgttttgtttggcctgcaccttgtgtataaacacaaaacatagagcaaacattttaaacttggatgacttcacaccacagtccagatttctggcttctctttgaaaacatcagaaattctgagagtaagggagatttctgtccacatgccaagccttctaagtcccaaagcaccaaccttccactggagagtggcctgctggctcttctcattaagaaaaatctccctctggctacacatgatgaggggcctggaggaattaagagagatgaggtagctgaggacacaggtccaggggaccagaactgaagcaaggaaggagaaaggagactcagcgctggttctctttcacggggtttttttgtctctcagctcagctcgctctgtttggctggacacagaaaaccctggaggagaattctgattccaacttgctctttgcacagttaattatttggagctcccagaaggttggagagaacaatgacttcccctgcagtggcagctggactagcttagttcccttttctgcccccaggggtcagaacccaaggaaggggggctatttgttttggccttaaaccaaatctgcctagagacacagagcgatgctctgacctgagaccacaaaagctactatttcaatgcctggtaaagctcctctctcttgccgtccacagcagtctactgacgaaaaacgcgttttccctatgcaaactgtttacttctctcctttgcaaattggaagtaatgtaaaaaaaaaaacaaaacaaaacaaaaaaaaaaaaaaacagaaagaaaagaaaagaaaaaaacctatatgcacaagaattccatctctccttgcaaataagatatttcacatttccttaggcagatagcatgcagacaagtaggggaactaattgggatggatcagtgaaaacaacgaaagctcatttatacacaacttgctaagtgtccacaactttgttctaataggggatccatgacaagtccctcaaaaacagagaaacaggagagaataatttacactttatagttgtgagccctgtaacagtagaacaaccttcctgcagtcccagagagattgtccccacatctaaccaaaaccattaccatcaatggtgtcctgcattttgaacagttgttaatgaagtcttgcctgacccaatacagagtgaaatgggtgtagttgctgctacaggctgccttctagccttcctgcatctgaatacattttctctgttggctgttctgatagagattcatctggaattcttaactagataaatccctcaatgacaaggtaaggcccatcttctgattaaacttgtattgaatttatttatttggccaatcatgtaatccatatttattaggtaccttttaagcaccaagcattgtgctgagtgacggggatatcaaggtgagtcaaaacaaccatagtccctgtccttagaagtccagaggggctgggtgcagtggctcacacctgtaatcccagcttttagggaggcagaggcgggaggatagcatgagcccaggagtttgagacctgccagggcaatataggaagaccccattctccacaaaaagggggaaaaaagcaagtccagagaaaaggaagctactaatcaaaagatctcacaaatataaaactgaccctctgaaaggtgtataagaagtattttggtactaggaggctctattacaaagagttcgtctagatatggggtggcagataatttgtctcagaagaaacagtacttgagctgacatttaaagccaggggaaaagcatcataggcagcgggaatcaaacactcaaaggccttgccgtgaggctgagcagtaaacataaggactgaataaagaccagtgagattggtgtggagaatgcaaggaatagagtgatgaagatggagagttggtagggaccgtgcaaggccttgtggagcacttcaaagatttccagcaacataaagctatttaaagatgtttaagcagggtataatggtggtagttgatgtgatcagatttacgctttgaaaaaatatagattagagttggcattttggggggacacagagtagatccaggtagatccaggtagaccaagtagtctagacctcctaggtcacaggtgtctaggaggggatggtaatttggacttggatggtatggcgctagaggtgatgtagccacattgacatattctaacaatagttactctggtaccaacccaatataccagagtcatccaatggcccaagagtggtactaactgtaattcctgattctgtgaagctgagtaaaaacatttagaaagaccaaactaaaaaggatctgaacgcatctgtactccctcatccccagcagcaaggtaccaccacgtactctgagtgatcatagctttatacttgaattgacaaattctgcataagactccacaggaaacccattaaataggcagggaagaaaatgctcaccattcagcattgacaagaaagatgataacaagcaagttttcagtcaaagtgggtaaaatgttgaatttctactctagtgtcattagcactgcacctgattttttaaaacaatattttggttaatcaaaactctgggtcaatcaactgttccacagtgacagctcctgtggtcatcaatctttgttatcgcttgaagctgacatggtctcggtccacaggagagtaagcagcaaaagacaaaggtttctcttcatttcccccaaagggagttaagcaatgagtcataaaagcatctaaattattcacatggctttccagaagtttatgattcaagatttgggagagataattgaaggaggtggggtgggaaacgtaacactggatgaacacatttattttgaaaatgaaaggatgagtttctgaggtagacccaattaccacacacagggcttcaggagcgacagcagcggcctatggttccgccacacaatgcttcattcattccttacatgggttcggacgatcattattaacctacagtcacctgagaaaagctcagtgtctgccaatcagtcacactggacttttgtggaaatggaaaaaggaagagagagtaagaagggagggatggagcaagggtatggagggaatgtgaggaaagcacaaggaggggccagaaggtgtcagctggtggaggagataaaatgttttctgtttctgttttacttgtagggtataagaaagagacatcagtgtgaagatatgccactgggtaggggctgagggttgtttgtatgtttgtttgttaataaacgtggcttgaattagatatatggctctccgttttagtatataagaaatacaagtaaaagagttcagctattgtgaaacttcattctcttgccaaatggagtttccttgactgtaatgctccaagactgaaccatgtacattcactatttataaaagctagacatgcatttattgaacctaccagatgtaggtactgtaaccaggcatgattaacagtagaaagaactgaaaaacccttcatgattcagccttagtttaccttactggttttatctcctgtgaattctcctttaaaactaagatcacagttctgtggttcttggaattcacaaaaaaaaaaaaaaatgctctacttcccctctgtgtatgtgagtattctctctgcactgaatgcccttcctccttcatctagcagcactgctcctctctgcctggaattgtctaattcctgccattcctcggatctgtttagacataacttcctcaggatgccatcctgaattctgagctgagtcaggtatcccttctcagggctctcactgagcttatctcaacagtagtctaggtagcattcaatcataattagatagtgtgcaagctttctgatggcagaggctaagacgttatcatgtttgtatccccagcccctagcacaccatgaaacacaaaatgcccaataaatttttgctgaataaataaaaaaatacaatacttgatacccaactccaaggcactttcagtgtagttagtaaagatagaacattttgaaacataacacagcacagggcaatatgaaagaaaataaaaaattaaataaatctgttataagcaacaaagcaggtatttagagaaggcaaagattacttttagctggggtgacaggagcaacagaatcaacgacaattcaatgtgtgttcatgacacaagtcctgtgttagttgttttcaacaacaaccctgtaacttgataatattatccccattaacaaatgtggaacccaaggttcagagaggtaagtgatttttcaaggttatataatcagcaatgccaggatttgaatgatgaatctaagatttcaaaacactgagaatggaaaggtgggtatcccaggtagagtaaaaacagaaacagaaaaaaatgtgcaagtgcatctcagtgtaatgtatgtcctggggattaaaaacaaatcaacttgatataatctattataggaatgctaaggatgctgatcctagcaagtaagctgtgactagactgctgggggccttgagtgtcatgctgaggaacttgggtgctgaggagccattagaagctttggagtagagaaaatgtgatcagagctgaaactctgaaagccttattagagagtgggagataggatgaactggaaagataagaaggaagtttgcaggcaaggtaattctgttggggacaaaaaaacttttcctttatcttcttatgttaggtatttgggggcctgcaaattaaactgacaaaccacagattaacaggagaaaagtttatttatgtgcatatggaagcttacaaaagaagtaactcaataaatggttaaagttagaggcttatacagtcttgcctgggtatccatggggaattggttccaggaccctctctcgccctccatcggataccagaatccaggttcacattccttatataaaatagcaaatataacctgtacacatcctcccgtataatttaaatcatatctaggccaagtgcggtggctcacacctgtaatcccagcactttgggaggccgaggtgggcggatcacttgaggtcaggagttcaagaccagcctggccaacacagggaaagcacatctctactaaaaacacaaaaattagccaggtgtggtggcacacgcctgtaatcctagctacttgggaggctgaggcaggagaaatgcttgaacccgagaggcagaggttgcagtgagcctagattgagccactggactccagcctgggcaacagagtgaactccatctcaaaacaacaacaacaaaaatcatatctagattacttataacacctaatacaatctaagtgctacataattattacattgtattgtttaagcaataatgacaagagaaaaaagtctatacatgttcagcacagatgcaattttctttttttcaaatagttttgatccactgttaattgaacctcagatatggaggggcaaatgtataactaccttagtagggaaaaaggagtgggagaaaagacctctttggaaagaataagcaggtttctacaggaaaaacaatgagagataagaaagtttgtaataatgtttgttcatccaggtacgagtggtctctctgtcttcttcaaggctataaaactcccccagagaggatatttatgatatattgagtctccttcctaggagtaaaagccaccctgaagaaggaatttatgaaagcctcatttcccagaagtttctgctattagtcaaataagagaagctctgagacggttttttttccgcatctgttgaatcccaaatgtcttcagcttaaaataatcttcagaccaactctgggcttctgagtgggtacccgacattaccacctaggagcctagcacaactctccagctccaaaggcactgatgtctgggatggagggaaagggtggattcaagccctactgtgagagaagacaccaacagcccctaacagctgagttattgtgcgtctgaaagagaaggaactaatggtgacttaaaagcattaagccaagatgacagagagatcattgtcaccactaacacaaataaggaagccagtcaggagaaagtactagtttgaagggggaaattttaaacatgctgaataagacacagcaggaaaaatctctaggagacaattggaaacgtggaaccagaaaaccagaaagtgatcagtgcaggaaatgcaacttgggagtcatttgcctaaagccataacttgaagccatagtaaatgtgggtatatctccaaggattaaggaatagagaaagaagactagaaggtaagcaacaaatcttagttaatactcaaatttagatggtctgcatgtgacattaacaagtgaaagatacaaagaattaagattaaagtgcccagtataagtctgacactaaactgggaactttttctatgtcattttatgacgtaggcactacctctatttcattaaaaccaaggctgagagtaatgtatcttgtcaaagccatataactagtagacaacagagatgggatcaaaggcatgttgcctcactcagggaccatctgactcatgccttcatggacaggactgtgggatggagggcaatggaggaagagttttcaggagtgcataggatgaacgtagtcaaaggcaatggggaccgagaagaggccactgaattctgagtcctctgagaggactcacctctcagaaatagttgcagtataaggtctaaaatcaaggcccccatattttgtgctgctttgacatatggagaaattcaggagggcctcaaatgacctaatgacaagttcccctcctgacatggtttggctgtgcctccacccaaatcttatcttgaattgtaactcccacaattcccacatgttgtgggaggaacccagcaggaggtgattgaattatgggagcaagtctttcctgcactgttcacatgatcatgaatcagtctcacaagatctgatggtttttaaaatgggagtttccctgcacaaggtctctctttgcctgctgccctccatgtaagatgtgacttgctcctccttgcctttagccatgatcatgaggtctctccagccatgtggaacagtaagtccaataaacctctttcttttgtaaatcacccagtctccgatatatctttatcagcagtgtgaaaacagactaatacacctcccagctctgctcctgcaaataaagtcccccagccaaacaaccctccctgtcatgtgaaccaggcatggttcctgcttattcctcttattccggagtagtggatttcagtttcctgccagcctgcagaattattcagacaagccgacttcatcctcccatagaaacagggataatcccacccctcttaatactaaagccttcttcccacatcccctgattgctcactgtgttcccaagtgcaactcccacgtggacctgtgtggcactcagggtccttcctccctgggctgtgagtatatgtgactaacaaactgctgtctcactggtccagtgttgttcagtcatctttctaaccctagggtgggaccctttctcaccaaccaggtaagtcgagagtggttagaacaacagaagacaccagagtgtttactgtggaagtaacatgggtgaaatgcttcactttaataactactggctttattacaactgaagaaatctgagaaatggatgattactcttttctaattttatataggaggaaactgaggaacagagaggtgttcaatggatacttagagtgagacagcaccaaattatttttctcactttaatgttgcattgttctcaaatattttttttacaagatcctttccagatgcttctatgagaatcacatatatccagtatttacagaaagccattgcaagcaataaggaaaatccaaaaagcaaaatatgggcaaaggataggaacagataatttccaaaagaagaaataggaatgccaatgatggcataatgtccaacctcactatgaatcaaagaaattcaaacaaaaattacaacaaatatttttgtccctttttggttgagaaagctttatactacccactgttggtgagattttaaggaattggagatgctcatacacagatgggataagtagaaatcagtatctctctgaaaggcagggtagcaactttctcaaaatctttaatggtagtattttatgaaaaaaaaattcattcgtaggattatatccaaaggaaacaacttgtgaaattcataaatgtatatggatgagaatgcttattcattgtttttttataatataaaaaaaccagaaacaatctaaatgcccatcaaaaggggataggctaagtaagttgtggtacacctataaaatagaatactatgcagtcttttaagtggaagatgtagatgtatatttatcaacataggaagatgatatttggttttaaaaactaggttataaagctgcaggtggaagagtacacatattatgtaaaatgtttataaaattttgtgtttttctacgtacacgcataatgagacatttgttgggaaatttgcaaagttttagtattccatagtcttcaaatttcaggtgagtcttactctcttctttagtttatcccaaaggcacatatcagtaatcaggaaataaaaggttgttttcactgggggtgggggaacacatggagaggaatgaataggtcacctcaaaaagaaagcatacttcaggaagaacttacacaaattacacaacatactttgcttttgcacttattttttatttcccaacagataacacgtgaaattccagaaaggggagaatcaattgtgcattcgatttttcacagggagctcatgaaactaaggcttctgtgcagcagcagggccatggagtggaaactggaaggcgactggggtcagtaggtgctggccagtccctctctgattgaaaaggacatgtgaagggtgccaagtgagacctcctctccaagttctcaacaatggctacttttttgcgttttattttgtgaacaattcgaacccacaaccctggatacattccacttgtgtaggtttccccttcagacagcaaatgctgctgtttccaaatccaatcatgagtgtttgctgttggagcgcttggtgtaaggcatgtgtgtcctataaaatatgtttctcaaaacttaactttttaagaaatcagtcactggtttatctcccaattctatcacccagaagaagagaaagatgccaaaacagatcccacagagagtttcattctgaaaaacagacatttaatgtagttattctgaaaaaaatacaaactgtattatgtcactttagaaatttcaaaatagagatctctaggtatcccgttaggcatctgtcgtgctcccaattacattactttcgacagccctaagagaagcaatatttattggcctactaagtctttaagaatgcaaaacttaacccatctggaactagttgtgttgttggctccagggttccttacatcagaacaaattcagacataaactctgggacagttcttgaatattgcatgaaggtgagttgcaggcattcacacaacacagcattgtcttttaaagcatttttataaagcagatccaaaggctggcaaacctttccttcaccataaaggaaatctaggctaaaggggaaaataagaagtttatgaactattaaaaaaataaagctgtggagttagggagttatggattaggttccaatccattaattcttttattctctggcagagctggctgaagatgtgcagccctctggcgggtaacagaaacattcatgtccagaacaatcacaaaaagggagagaaatggctggcagagcagagggcggatccactcatttggatgttaatttatacagaaatctggaattcaataatctcacatcccccaggtaagggagcgatccactctccaatttcatttgggagttctattacattaagcaatattctgtttggccagacatgccattcttctcttgaaggaaattaatttcttgattcttccatctaataatctaatataatcccaagtcagtgctttaagttttctcatgacactactagacaaaataaactctgaagtacctcttgtgggaactcacaagatacagatgaaaacaaaagaagaaagtaaaattgaagagggtgaggccagggacaattaggtattgaactgcctgccctgcctctgacacatgatacatgtgatttgttaagacgattttctatccttaactcttcactaagtagggctgctttacaatttccataggaaatttatttttaagtatgtaaggcctgtgaacaggataaataaaagattacaaggaaaaaaaaaagcagtgatttctggttgtttaaaaggcaactcaacaagcctttcccagcaaaaggaaaaggtcaggatcaataaaagggcctttcctttgggaggagatctgttttcaatttaacaaaaataaatccttatggtgtagtcttctgaagaccaaggaaacatcaagctatacaagggatctggccttaccaggataagaaaacttcttcatttgatattctccaataatatcaaaacaaagtaaactgtacccactttgcactctttctcggccccctgcctgttagtgaaaggccagttaacctgaaaaatgaaaaccagctcttaaatgtaaagatgatactactcattgatgcaatgttatcctgatagtggcttttcagagatatcatcttaagcgtgatatcaacagggggaatctcacatacgagtagaggctggtttagaaaaatcctgcaggatatggagtgtctttggtgacagaagtcatactcttaaaggtatcttggtcaaactcatcatctcttactctttttatattagccgggcgtggtggcacatgcctgtaatcccagctatttgggaggctgaagcaggagaatggcttgaacacaggaggcagaggttgcggtgagctaagatcgcgccactgcactccagcctgggtgagaagagtgaaactctgtctcaaaaaaaaaaaagtactggctcaactactatgatgagaagcttttgggagatactcagtggtaatgtcagccttattttctgtggcaaatctgaatctttgctgccgtaacacagttgttttcaacatttaccctttctacactcataggcacacacacaattttaactgatgaattcatagaattcataaacctgacagtgtcccattgctggaaccttagtcatacccattcctagctcttgctaactataacttctccatttttccttcctctcaagaaagtatattagattgcaaggttgcaagagagtaagagtcttaaccttaaatatgctttcatttattagaaaaaaggaaatcatctgcatccttcagcaatttaaatattattagagaaaaacctggtgggattcagcatcaaagttattctcctttctggcatgacctcctctcagcacttcttcaagtatataaatcctaccaatacctcaaggtccatctactctgtattctgaaaatactccaatctcctctccctggaatctaccaggactctcaaactcaagtgttttccagcagtcaggaaagttagttgcatgctgcaggccaattttcaggcatgtgtgtttactggatgagtgatgaggacatgacaacagaagagaacacgtcctccctgaagggggcagcagccagtcagtcccatcccattgctgtcaggtgggaatgcaggcccatagctacccgatcttccaatgttttaagataagtcgaaaatctgcattctatggataatatctcaacttcaaatgttggctcacttaggatgacaatgactctgtgatctgcattggacccatggaaccactaatttgcaacctctggtttctacaaaacatgaagctgactgataaatgacaagcttgtgccatttatcagcaagtgtttgctatttcacatcatcagtcacatcagtatttcagagagccataaataaatgtataagttataggtaacaaaaataaagcagggctttaacttaattatctttaatttagcttatttaaagtttcaaataacatgtaaagagggcctgagatatttatatttagaaatttagagacattggttaaataagttaaggaacaatgagccagactctgaagtcccagcaaggagggactgtatctttgttttattcagtacctatcaagagtgctaagtacacaggtttgaatggaactgatttgaatcatttaaggaaaaaggttccagacaaacattgcatgcattagaaactgagtatttcccgattaaacatacaccacccttacatttccaaagtgtcagcaaagcattctgttctttggtcaaatcttgtaaaagccacttactcctaaatatttttactttgtaaccttcaccgttccaagttcatctaaaagaataaagaaaatacctggcacagagaatgcattcaaagtgtattagttaaatttcactaaaaagaagtaaacaaaagacaaaaaacttcaatgcatcttgattctctgtagagagagcaccttgtggcttgggcttcttctatcaaacacatacccacacctttttgtcagataaactcatttggtttttcttgtgtaatggggtgagtattgtacaaggtttcaatgccttttttttccaactcacattgtcccttagaagctcgaagtactaacaaagtgcttcaccacacaaaagtgctgtctacatttgtctggcaaatacgatgccaaacgaaaagcctgatgagtctgcaattcgtcatgggcatgatcaagctccaggctgcttccaccagagagcaaattcaacattataaaggaagtgtggacaggaaagccttccagcaagattctcagaatatggacatgagattcaaagactaataaaatgggttggggagacggtattgatgaagaagcagccggagaggaaaaaaggaggatttgagcagatgtctgtcactaaagaaagtgaaagacacagaggaaagagaagatctatgttatcacctgtgatcctaaaacaactctaggaattaggccgcattatccttgcttttatagaggaagaaaatgtggaacagaaaagctgaataacttgtcacagtcttacccagccaattagtggcttaactggagtttggccaggtctttttgtctgtatagcacaaaccttgtgaccacacagcactaacttccaataagtcacccaaaaagtcagctgcatgtaattagctctgctgtgaaactatggactggggaaagggcattgttcatttgttagcttaatttttgttaaaggcatacaagaccaaccacaaaaaaagaaaaacaaaaacaaaacaaacaaacaacagcaaaaaaaaatcagccagagctgtagaaaatcaactctgtcattagtaagtatattttattcaagtatgtgttattaatatatttgagatctcccaaatactaaagagatagaaatttagatacattggagataaacttcaagtaagctattttttcactattgcataaatgggaagatattttcattgaaaataatgttcctttactcaatcacccaatatttattgagaaaccacctgggccagacattgttctgaattctgaagatcagagagtgaacaagaagcaactgactttgttttgtttacagttcagattgaacaaagcaatggcaacagagaaagaaagagaagccatttatggtttgtgataaatgctgtgaaggaaatattttctgatagagaatgaatggaaaacttcctttaggcaaagaggacaggaagggcctccttaggtgattgtgtctaaatgagtcaagcatgtcgagggttgaagaaagggtgctgcaggcagagagataagagtatgctaagagccggtgaggacactgaacttagctcttcctgggaagtggcagccccttgagttggtgcagtgaccagggtggacatgtgtagtataagcttcagggaagaggtgagtagaaaccagccagcccctcatgggtctggtataccactagagtgcgtttggaattaattgtaagcacaagagaaagctgttgaatgattcagtcttcaacaagggaacaacatgaacagattggtggttttattttggctgccatgtgaagaatggatgacacgacactcgcatagaagtggaagactagtctagagtttggaagatagcacttggacgtcctgctggatgcctgccattaccctctggatctgccctccaccctttcctcgcctgttgcctgcctcagaggctggcttacatggactacggcccagggctctctagcttccagttagtttggtcaatgggaaaccccagccagagatcagaagggaggagaaagaacttaggatattagtccctcagcaccctgtcacctccaagcagagtttctcacaggttggttgtatcccaccacccagggctgctggtccttcaggtggcctctgccaaggggcctgtcacacagctctccctcaggtcccaataaccttccctctcctatgcctctttcctcccctttacccttcaggagttgagtagcatcagaaaacgctgcagctagccccaaggtactgcactctgtcttgtagtttgaaaatgctacctttgttaaactctagtcaaattacccaatgtatggatgccatctgtttcctgtggggctgactgatacaggaagagagaagcaagatactattttgacacgttcagttactgtgatccttgagtaacattctgtttagcttgagttcatataactcaaaaggttatcaaggaaatcttacacccttttacctttttaggagaagcaacaaattcaccaaagaggtaaaatgccaaaatcatgggcgtgcggattcagaaaataaaataagcattagtggtcatcagtatttgatttcaggccaattgttagagctgtcgcttaaaaatttagatgtacatttctcattccatgtttcatttattcaatcaatgtttattgagtgcctactacttgcaaggcactattttatgaactagacatagagcagagaccaaaacaaaatgcctactctcttggagcttacattctgggggagaatcagaaaataaacaactcaatgatatcttatgtgcttataagaaatggttaacaggaatagagagtgggagatcagcaagaggactgctgatttataaaagacagagtaggcctttcttaaaaggtgataatctgagcagagatctaaaggaaaagatgaagcaagctacggcgatgtccagggcaagtgtgttctgggggcggaaatcatgagatgacgaggtgtgggtggcacttttgagtaccagtagaaggccagtgccactgtagcagaggaagtaaggaggacattggcagcctatgcaatcagggagacggcagggacaagatgaatagcctcaagaactttggcttctattttgagacaataagtttttatggttttgagtagaacagtgataggaattgatttaggttcaaggggctcattctggctactgtgttgcaaataaggtggcaaggatagaaatagagaacacttacgcaaaagtctagagcaaagatggtgacttagaccagggttgtagcatttatatttgatatgccatttaaatatccaagggaacatgagtaggcatgggatgtgtaaccgaagtctagagttgaaagaagaggtctaagctagagatagagatttcgaaaacatcagtatttaaccttgacagtggatgagattttctaggaagtgaggagagcattaagagacaagtttttaaggatggagccctgagtcattacagattgacagatcagaaagaggatgatgaccagcaaggagaccaaaaaggccagtgtggttaagtgggaaaccaagagggtgtggtgtccccaaagccaactgaaaaaaaagtatgtcacgaaggaggaagtgatcaactgtatcatgtactgctgatagatcaagtaagaatagaactgagtagaaaaatggatttggcaaccaaggggccatggatgacccagacaagtgcattctgagaagcggtggggatgaaagtgggatggagagaacatgtgcaggcaactcctctgatgttctttgctgtaaatgggaagcagagaaacgtgggagctggaatgaattatgcaggcttctttctttttttcttttcccttccttccttcctgctttccttttttccttccttcctgcttgcctttctcccttcttttctttcttccttcctttatctttctttcttttctccctctcttactctctttatttcttttctttatctctttctctttctttccatttctctctttccttcctttgttctttttctctctcctttcgttctttcatctctttagtttagagacactacagcatcttcatatcctctcagaattgtctagtagggagaggaacccaaatgatgcaggagagaacagataattgcggaagccaagtgtttttgtaggcatgtgttgaggttcacggcaccatgaaggccgagggtggaagcagaacagttcagagagcacatggtctaggagcaggtaggctagtgagagcatgtggaggtttcctcctgactgagctttgctcagtaaaacaggaagtaagggcatacacatagcaggaccagcagagagaagctattggagatctgagaaaagggtgggaaatagtcatccagggcaagtgggtggagtagggtcctgcagtaggattgctgagcagtgtgttgggctttaaactgcctttcatatgaatccacaaatcctactaatattaatgaaagatattaattttcatttttcctgctcccgtcagcttaaaacgaaaagtttctctacttagcccatgaggagtcagaaaagaaaaagtaatgcccagcaaatttctccttcctaagctagaaaggaaaaaataagatattcatgtaaggaaaataaagaagacatggcaacttgaaattatgaagaaattccaaatgttgcatttggtagtgttcttaagctaccataagagatcttcattctattctgggtagggagaatgtacgtggcagttgctaggaatgatcctttgcccgtgatccttcccatgtggtaccccactgtccccaatagacctgagtggcacaaccaacaaaacaacattcaaatatatggaaatgatctttattttagactctttctcatttagcctgttgggctccgagaatgtgaaaaataaatctgaagccttacttttaatagctttcttataaattatccccagtatgtaaaagcccagctcctagatataaccagaagaagggggaggggggaaagactaatgacctttgacattaaaatttaaaatgtcctgcatgcaaatacactttcctgccactcttttgtaatgcaataaccagcaagaattagaattgcaaaaattccaaaagagctacatggaaattatacaacaaagtggtttcacagtgatattgagaaaggaatatgaaatgaatacaagataacatagagacagaatggggtgttacagatgtatgagtgaacgtgcgtatgagcacatgcatgtctcagagagagcaacagataaaaaattatttctttttttatgttgctcttcatgagcaaaattttaagacagacactgttctggtcacatttcaataatgtgacacatggtttctatttacattccaaatgagttttcactaaatgactttcgaaatatttacttgcaagtataaaggagaccctttgaatgtctgatttgaaaaaagaacaaaatcaagcaattatcaacatagatgttctaatacaaactgacactattttcttccatgtcttttttttttttttttttcattcctagacaccacaaaagaccaatgctacagatgtctctctttcggctttaaatacttcaactgtgacaatgatagtgagacagactgcttcaggccctgtagctaggacataataaataattcaaacaagttttgaaaaatcatttggcccatataatataccagctatccgaacatttaccaatgcccgccccctcccctcacacctcatccttattttcattttttgctgcttccatcagcttaaaatgaaaagtttctctacttagcccatcaggagtcagaaaagaaaaagtaatgcccagcaaatttatccttcctttgctaccggcttccattaaattgaaggtgacttcacattgatcctgggttcaattcacatatccaaagagacctcagtgattaacataaagggcagtccaatcaaggatagacacctccatgtgtgtatggtgagcaatttggtgggatgtaaaacataaatgatgtagcatcagaacacctggtgtggatgatgccaccacttgcctacccagttattctccacttcttgccctgagtttttctttctctctctctcttttttaacttagataaaaaataatcagcttcttaacctcccttgcatctaggagtcatcaaaaagatatcggttgatcaataagatcaataagaatttgataggcagggcttccaaaaaagtctgttgaaaagggaagactcagataacacagtttgttagtgtttgccttttgcccaagatccttccctctttcttctgcctgtgatgcccagggatggagtagtcagtttgtagcctatgaggacaaaagtcccatggcaaggcataaccatgcagaaagatagaaggaactgtgtcccgctggcactttgaacttcttgaggcatcttggggaaaataagcccctccttggtctagcagtatgtgacagttaatttcaggtgtcaatttggctaggccatggtatccagatacttgttcaaacatatctggatgtcactgtgaaggtaatttttagatgagattcatcattaaatcagtagactttgagtaaaacagattaccctccataatgtgagtgggcctcattcaattagttgacaattagttgacagtcttagaaaaagagtagcatcccccagggaagagggaattttgccagcagtctgcttttggacttgagtggcaatatcaactgttccttgggtatttattgtgttggcctaacctgcagattttggactgagatctcagccttcataatcatgtgagtgaacggcttaaaatcgatcatctctgtctctctctggagaaccctgactgctacaccattacaccattctaactgggtttctgttcactgaaactgaatgcaattctctctgacacatctgagatcaccacttcatacactgtgtaactgtgtaggtgtctgtgaccctcagcttccagatctacaaaatgggaatatgagtactcctgactccacaggcttgttggcttacacacgagacagaatgtgtaaaagtgctgtgctgtgttaagttacaaagcccaatcgaaatgatagggatcattatcatggtgggctcactgtcaattcacgactgtaagtctgttatgattgtattcacttaaaataataatattcttcaaatctgaccataaaaagtcattatagaacatttgaaagttcaaaaacgcatgaggaagaaaacactcaaccacctccatcattccatagctactgtcatctaccaatacctagcatttattgagttattatatagcaggcaatgtgtgaagcaattcaatgcattatctctaccctgtgaaggtaggtactattttggtgcccatttggcatatgggtgaaaacttgtcaccggacatatagctagtaagtggcaaatccaggattcaaacccaggtctgaattattctaaagcccatgtatgtatccagcaacacatggcgatgagctgtgttctttaataatgtattggctactacaaaattggagtgtgatcaggtaacccttacatcaggaaaaatggggtatgcacattgctcagcatatacacaaatcaagactcatattacaaggctgctagctctcttgtcagggataacattttaatttgaaatgaagtggaagaatgtttcatatcagctactccggttaacactgctttttacttcagataaagatatcccttctgtcaggcaccctgaagtttttctgtaaaaagttgtgttcatttgtttcaaactgcccatacatccatggtctcatttcattttccctatagcccgctgagttaagaggggcaggtattattaactccatttcacaggtgaaagaactgagccctagagaggttaactaagttgcttaaggtcacacagcaaattagtggtacgacggggattggaaagcctaacgcctgacatccagcgtggtatgttttccatcatgtagtgctccatcacctgtcactcccaccattcctgaggggcttggagttgatggggcatgctatcaatttctcagggtaaaactgtcctatctgggtaggaaaatgcacacacacacacacacacatatactagacacactgtaattgcatctgccaaaatggttttataacaatccagtcaaggatacagaaaactcccaggctgcctttcagaaacaaagcccaaaggatcaatttcatcatgaaataggatttcctcagctgtaggtggatgggtaggtggggaggtggatgaactgcattaacaatggaacagtggactgcagggtaaaagctcatttgacattcactgctattaagcagtggcaatgtaaacctggggtagcaaagagcaatacccaggaaaaaatacgaagaaaagtttcaacttaacccttctgtaactttctatttataagtctcagggtattaagtctcattctttagaaataacaaatgcatattttgactcactctgtaagatatttataagaaataaagagcaagggggtattgattaagaaaaaactaggatgagattatagatatattaatatgtgttaatatacaacatataattacatataattaatatataataaatgtacaaatatataatgttatataaatgacatgtcaatatatgaatatatatatttcaagatcatattcttaacctgaaaccaaaaaaagtacaaatagaggtaacatattgcattgtctatttagcattgaaaccaggattttcagatagaaacatttgcctttcctaagctacgcaagccatcagatatttacctcagtggcactggtctcagtgaaacatcttaatgtctcttctctcagttggttagatgaatggatgtcataaggtaaaaagaggaactgcaagatttgaagctcatagaaaaaagactggcactgggaatggcagttaccgggagattgaaacaagaaggcttctaaatatgctgtcaaaaccagcaccagtgacctctcatcaagtgaggggcagcactaaaagctataccttctagaatgatgttaccttgaaaatcatgaggaaatctcaagtgtctttctactacattagcaaaaggaagtttagggagtttagacaccaagagactggaccttctcaaaagggaatttgccacagaatcatagatgttcaaaatgtgaaccaagctttctttcaaataaaagtgaatatcagggcttaaaacagaaagacacatttcatcaaaaatgattaggggcccacgagtgttgactggggaatgagaatagtgggtaaggttagggggaaagccagaaaaaaaggtgaatcaaatatacttacactaaaaatcctggggctccatgtgatccagtcacggtaccttgtcacagagagaaatgtaatcagggatccaggaagttctttacaggtttacttggtgtgatgcttaatattaggtgtcgactagattggattgaaggatgcctagatggctggtggagtattgtttctgggtgtgtctgtgagggtgttgccagaagagactgacatttgagtcagtggactggagagaaagatccaccttcagtgtgggtgggtaccatccgatcggctgccagtgcagctagaccaaatgcaggtggaagaaggtgcgataagctggcttgctgtgtcttctggctgccttctttctcccatgctggatgcctcctcccatccctcctgcccttggacatcagattccaggttcttcagcctttggaactcaggaacttgcaacagtggctcagactttggccacagtctgaagcctgcactgtcagcttttctggtttgagcctttcagactgagccactaccagcttctctctctctcaatttgcagacagcctatcctgggactttgccttgtaatggtgtgagccaactcttcctaatatattcccttatatatatacatacatatatcctacttgttctgtccctctggagaaccctgactaatatacttggacacatgaaaaattattaagaagagatgtctattcttaatgcattaagaatactgtaaaattattctctcctcattgctgcctttctgaaaattcttcatgtggttggcagctgactcaggagcactctctttcctggcacttatccaatggctctaacacccaatctgggcagcctgtccggcttactgtctccatctctccactcttgcttatgtacttcaacacagactctttatttctttacttttatttctgttttctttactttagggaggacctgggagtttaccaggaagctcaaattcttcctgtatagaagctaggaaaatagtgaagattgtgactatccatactcgaataattttatcctataacatctcaacagattttgtctctaagaattctattgtctcaaataaacccagaagttagcactttaacatgggagccttttcaaatggtagagtctcaaggccacatctgactccagagatcatggtgttcctacaacactgagatgatgataggaactacagttgaaaacagatctttctccccacatcaccttgatcaagtcaataaatgttagtatatgccaggtactgggctaggtagtaggaacacagagataagcaagacaagatccttatccctgaagaagtcacagttcagtgtagtatttctaaaattgcattccttagaatgaaagtgacccttgtaaaaataatccatggaccaaataccttttggaatgtggcatgctcaatctccttttggacatttttcatgctcatcctaatgcgaaatgattatataaacttcagttctttactccagcatttcccacatttaactcatcgctgacccatttggcttgcaaaacttacgtcttgaattgagcctacaaatgttaacagaaattctaccattagcttaaaaaacagacaaataacaggcattttaaagataaaataagaaataatgatagcattttaatataaagtaaatagtatttcaaccaaaaggcaagtgaatctgtatgttgtcttaatggagattatatttgtttgctcactacagtttataagaacagagaggatgataaagacaccacaatgatgaccatgcacagagtgtttctatcagcaagcctatattgtgggtctttactcacaatattttatttaattcttacatcccttctatgaagtaggaacttatatttcccattttcctccataaagaaatcaaggttcagagaatttgttaatttgtctgctacgatcatgtgcctggtaagtgatggaagtgagattctaatccagactatttactctgaaaacctagtggctcccaattctagttatatatcccagagaatctactgttaactgatttaaaatgtccattagcagagaaacagattaacaaaattcggtgtcttcacatgatagatgatcagatggctatcagactatctgtggcttctgaacagaaataagaaagaggctttggcaagctctagattagaatcaaagaaaggctttccctcttgttaagcaactcttgttctattgcgccccaacaagagacagaatgtttcaagataggacaccaggtgactgtgtggcctgagctgcccaacctgaattgggtgttgttttatccactgtctattacattgggtgcactcagcagcagctgtctgtatcaaatgaaagtagattacacgggattgtactattaggcttactctggctatccctgttttaacccaaacctaagacttcatggggcattttttatgtagttacctgaagaaggaaaaaaataaagcctactttacagacaacattgcacgataagctagctccagcctgaagtggaccctgaatattataaccccactcaaggtgagtagccctaaaggacattgaagaagaaaaatcccatcagtgggcaaaacttcaaataattacctcttgtggtcaacactgcctggaaaaatagttggcctgaggtattgttccacgttaattcatgggctcatgaatgaggcattaggaagaaaaagaggggaagactgaaagggaagggaacaaatacacagtaaggcttctcaaacttttaccagagtgtgaaaatatctgtctatgtgaatgtagactagaaggtccccactgtggagaaggcactcagtagctaggtaggcaaggcctctttccctgccaactcagagcttaatcagcatattcataaaagctatttagtatctacggtggccaaatacagaggtttgcatgggctgaccaataaggacttcaccagttctggccactgccactcccaaatgtaccacttgctagaaacatcaataaggaaatctgttggagagttagttttttgattcagtgaataccaatgtgctctcccacatttcctctaccttttgtggtaaggtggggccatgtgactagtgcaggccaacgggctacgaggaaacagaaacctgtcatgcctgtgaggggccctggcaaggcataccgcctgacctgcacaccaagtgatgaggtcagagaatgccagattgctctgcattctctgtatagaggaaaattgccccgcaaactgcctgattaatataccaatcctgaatcaaagatacagaaaaataccctgactggaccctccagccacctgggggcatgctgtttgtatggaccccatctatcatagaggagatgaaaatgtatacttcttggaaaagacatatactcaataagaattatttccctgtttgccaggcttctgtgaacaacctcaaatgttttattcaccttgatggtctcccacagaaccttcttgactaagaaactcattttatatgtacatatatttatatgtacatatattaaaaagtaaagcaatttagttggtgctcatgggattccatagtctcacctagtaccccatcctcaacagtggaatggccagttaataacttggctgtggttccagttaaaagacaacaccctgaaaagctaaaggactatcctacaggctgcagaatgttctcttaactagtgattaattatagtgctattttcccataccaagaatatatatgtccaggggtcaaaggggagaggggagagcagtgcctttcaccattacacagaacaaatcactcattttgctttccttaccaggaaatttgaggtctgctgttgtagaggtcttacaactcaagtgaaaaatgcttccaacaatagatatgataaaagaaaaacttcagccgagttaaatttaaaggactttaattgagcaatgaatgattcacgaatcgggcagcccccagaatcacagcagattcacagactccaggggtgcctcatggtcagaacaaatttatagacaaaaaaggtaaagtgacgtacaggaatcagaagtcgggtatagaaacagtgagattggttacagctcagtgtttgccttgtgtgaacgcagtttgaacattcagcagtctatgtgtggttgaagtatggccgctgggattggccaacactcagctattgttacaggtgcatactattaacttaggttttcaattttgtctgttaagctaggttacagttcatccacaaagactcaaatatagaagtatggccttttcaggccatatttagtttgctttagcagatgcaagagtgtttctatgaaattggaagctgaaactgtccagtggacattttggacacctcacaccccactcaaactgagtaaaaagggagttattgtgttgggaggggtcattagtcttgattatcagttgggaaatgaagttcctgctcagcaatggaggccatgaagagaatacctaccatgcaggtaaatcctctggagtattcctgctactgccgtgtgccatggtaaagggttagactccagcaaccccaaatgagcagaagcattgagggtttcctggatagaattactgatggactgtttgttcaagggtaagttagagtatgttaagtcagagcaaggtattataacttgaaagttgaaacatggagaaaaaaaaaaaggagtattattgatatttggtaccaagaaagggatcagagcgaaatttgtctcgcgtggctgcccaatatcctctggatattcttgctcataataatgtttgctccacatcatgaattcttccttttcaaagggaatttcagaaaactcatatcctttgcagctaaggagcaggcatgcggtctgccctcctcttctcaggccacacaagacttcactgtggaagtgagcaatgaggaaaaacaggctatgtgtggacattcatttttccagtataggcagtgagaaaggtatccagatttggggatgttaggataaattgcaataaaattaaatccttcgtatcctagatgttacagtcaggaaaacattgtggtatccagtaagtagatggtgacaattgcctcataagcccagttctaagaaaatgttctgcagtcaacagcatgtcaatggctgttttctgaccagaccagttctgcaacatagttttggacattgttcccaaaagcttagcctcaagcttatttctctgggtctacaatgattcttccaaatgccccatatcctttaataaattccttctctatttaaattagagcccattctattgtttgcaactaatgctcctgaccatattttccttctcccactttcaatacccaggcaaagattgttttaatcattcacaacctaacagttctctctcaggaaagtctaatctagcaatatttttttctgtggaatctgcaacctactcctttacctttaagccataagcagtgaatgaaactgactcctatttccagaatcccacctgcattccttttccaactcaatcttctttcttagcctaaggctagcctatttattgtatgaaatattcttttctgtcagtgaacatggcaacatctttggctaagtcaaaagcctaactcttcatctagctttcaacttggaagcacatccctggacacacctatgctttgaaagtaatatttatctctctctctctctatcccactgttcaacaatcattttgtctgctttttttgagttacactttgcatatcaatactctttctgaaaactcctccaaagtgttaaatatctggcatagtcatttcaaaacaggaacggagtggtctgcatgttaaagaaggcaagaatgccagaaattgtcccatttcccatgttgatcagtgactgtgtaactcagacacgttgcagaggcctacatggcctacttcctgagaggggggtctcactgccttgtcaggattccagtttaagagcacagggcaagtgagaccactgaatacagtcatttaaaaagtgctacaggaaagtatttaaatagtcatcttatagaagggggtgaaaaagcacatttattgatgcagtaattaaaaaaagatttagatccagtgtgtcaattcccatagaatcccacttagcccccttatctatgtcaaagcaaacttagtttcacatcagcagtgcttctcatttatcttaatgctaaggatttatttcttatgcaaaattgttcattttcaccagcctggaactttaaaaaaattcacattctcttcttcaagaatttttattaagccaagatgtcatcaagctgaaaatctcagacacaattttggctctcttctgcaggaaactcagaggagtgcccaatccaggcaacagcagattagcactggcactgctgacaggttcttaaaagtgttggaaagagaagaacaaaggtggtgtacaatgattgacaaagatttctgctataaactaaagttgaaccaataaatatgtctagactctgccatgactatctgtggcctggaagctgcattcttcagaagaaaaaaaaaaagttgcagttggaatttggaatggttttgcccccatgatgtgcacacaggactttgatgagtagtctgatatgcagaagcatccagattatcactgagatagaaatgaaacatccagatgatagattaagtagattgttcacttctcatctatatatatatatatatatatatatatatatatatatatatttgacatcatagaggcataatcaaaatctgagtaggtaaagtcactaaccagaatacgaataccaagttacctgtgtggtttcatggaaaaataataggggaattgacatcatctttataaatgttgtatcaatgagaaaattatgacagtcggggagatctgatctagcccatctgcctcctgtctttagcattcaagctgccaagctagctttgggagacatttactttacagtttaaatgataataacccttccccccaactcaactgcctttgtaaagctaatgagggaccaactgagggaaggagagatgcctggatgctgctaaggtacagacatgaacaattgccagccattattccagagatcacaagatttgcaacttccctaattactcctgcaggcaacatcactattgtagattggccttttgagatactgtttcaggttttttgcatgtctggcacccatggctctacttggacccaccaactgatggttcctctggccagaagcaactcagtgtaagaggacagcttcaactccctatgattaaatctccaacccagccaatcggcagcaaacacccattgcatagccatccctacgccttcgcccaaactacctttgaaaagcccctaacctacaagccttctatgagattgatttgaataataactccatctccggcatggtgtggctagccttctgtcaactaaactctttctttactgcaattccatggtctctgtttgtgtagcaggcaggaagaacccactgggtggtcacagaatttcaaggctgcaaagagtcagactttactcaaatattctaggcaaaaaaaatagaatttaagggttacgatctgcacaatcatggtcaaaatcaaagacacatcgaaacagttaaaacgcaacagttatcccaaggtcaaaaccaagaatatttatttattagtgtaccctgtagctctgtacccaattaagcccaaacatctccctagacttcatctccataatcatatgggtatctgatacccgtcaatgcaattttcttgatcactaatgaaacattccttgttcattgcattagtctttataatcacaatattaaatcattttccctggtgttttcccctagcaacaatttatgagccattacagaatttctgttttttttctatgtcttctctcttctcataagttaaaccattccagtatcttgcaaatgaccagacaactactttaagactttggttgtaactagagcttcctaccaagctatgtaattaagccacagtatctttgctcttctagcttacaagataatcatctgattcccttttgttaaactatttgccctttggccttatagtttattcacttgggaactagattacagtttcccagactatatagctacagagaaattattgtgacttattataagtttaattcatgccaaacaataccagtctgatttctggcttaataccaccttctttcataaagctggaccatcattttgcctttaatcatcttcttgattagtatttttccaagtgtttctcaactcatttcttctatagaattaaaacattcctactggatgggctactcattttaaggatttaaaattttcagtctggatttggggttacacctttgatggatgagcttaaggaagatacgaaaatggcaaaattatcttcatgatgacatcataatggatagaacaaagtaaattttataaaatggtttcacatgccttattccatttgatacttaacagacttgagaactggacagagtagatatagtagttccctcttgtgcacagggaatatgttccaagaatcccagtggatgcctgaaatcctgtatagtcctaaaccctatacatactgttttttccctatatatacatatttatgataaaatttaattaatttattctttttgagatggagttccattcttgttgcccaggctggggtgcaatggtgtgatctcagctcactgcaacctctgcctctcgcgttcatgcaattgtcctgcctcagcctcccgagtagttgggattacaggcacctgccaccacgcctggctaatttttgtatttttagtagagatggggtttcaccatgttgaccaggctggtctcgaactcctgacctcaagtgatctgcccaccttgacctcccaaagagtgggattacaggcatgagccactgtgcttggccaaaatttaatttataaattaggcacagttagagatgaacaacaataactaataataaagtagatgccagcatcactacttttgtgctttggaatcattagtaagtaaaataagggttccttgaatataagcactgtgatactgcaacagtggatctgatcacagagctagctataatgtcactaacgggcaagcagcacagacatcacagatacatgggatgattcatacactgggaagggcagagcagggcagctcagatttcactgtgctgctcaaaatggcatgcattttaaaacttacaaattgcttatttctggaattttccatttaacatttttagatcgagttgaccacaggtaactaaaactttgaaacagcagataatggggaactactgtattactatgcccatctttataaagcagtggtttccaaactgtgttaatgcagaccaaattcatgacattgtttcaaccagtgcagctcctttcatattagttttttaaaaaaacacatctaagtaagatcaccatttgaaatgaatagagtgtatgttggcttttaaataaggaatgtttaaatgcccctgatagaggaagaaaccaaagctcagtacaaatggtaaactcacatctccacctgtaaacaccaggtaaaaattgaaggagcagggacaaccacccaagtctccagcctgtgagacagccaggtgaggaggggtccccagaagacctccaactggcctgtgcaccggggtggagcctcgggaatttcatcatgtttgcagcggggaggagcctggcccttccttttcctgtgtggaacctgggattcaagctgtgggcgggaagtgctctatcagggactcaagccttgggagactccctctttcccctttacttctttttcacccaataaaaccctgctcaccctctccatcggtctgtgaacctaaattttcgtggctgtgggacggacaagtaccctgtctttaactgaactatggaaaagtcctgcaatatttttggcgcccaacgtggggactcgagaaggggtaagtgagatgcaaaccaataattctttttccctctcccttctgagtcttctcatccccgtggccttttccttccttttttgggatggaccggcgagcagcagctgcccactgctcctcactccatgccggggctgggacacatggcctaagtgtcctgcacagcctgctggctggttccccgtcactcctggctgtcccagccttccccttccctggccaagggatgtaactctatcagacagtaattaagcttaaatttgtctccctggtggaggaaccacttgcaaagaaatatgaggttcttcctcaggcacttttaaactgtttcttttctttccccttctctaccccatcagcaagttaacttaaatttttttttcttttagaagatgttgtactaggctagcctccacccacccccaacaactgtcagtgtattctctgcaaagtttcggttgtgaaatcaagcctccatcttgttttatatcctgagggcatggctggtaattgtggcaaggatttgtttagcaaagccttgagaggatgaaccctgtaagattcaatgtctgcatgttttcctagccctttctcttaaagggccccacccagcaactgggttttcttctgcctgcctgtgtgtgtactgtacgtaatgtttgtcaagagaactctaattaatacagcctaaagaaagacaagtgcttgaatctaatattttttaaagggaagataaagtctggtacctttcagttcacatgactttaatctttaagaaatagaaacagtcttaaaaactattggtcaaatgcaggtattatcaaaatgtaaataggtaggctaaataatgcaggtcagatgcaaggtttgctaagtgttttgaggttacaaactgctttttgggttttcagaactatattgacttgccagcttcacaactggtaaggcctggggacacacggaactaaccgcacccttaactaagaaggcaaaccttggctgcagttagcacacaattaaagcaacttaacaagttttagtttacagttaaaaattgctaggagttaattgaatccactagaaatagatttacatgcaaggtgtatgagaacagtaaaatgtgtttttcagtaaaaggttataagaagtcatggaaatgtaaacttttgcctagggttaaggattgttttgagttacattaggaaaaagctgaaggttccaagaagtggtggaagaattgtggaaattaatcttgcagaagaggttctctgtgtgaacatactgactacattcaaccaagggtattatatggtttttctgtaaattgagcgttgaagtaaaagcataacgaggttttcctaaggtgctaatcttaatctgctctttggcaaaatttgtaaagggttataaaaggttttcgcttcttcaaaatttctgagtcatcattttgacaaaataaataacttttggtaatgttgacaaaaggagtcaaattctgtaaaatatttttacagacttattgtgagccacatatgagtgaccatggcccgtgacacagccctcagaaggtcctgagaacatgtgcccaaggtggtcagggtatagcttggtttgatatattttaggaaagcatgagacttcaaatatatttaagaaatgcattggtttggttcagaaaggcaggacaactcaaagcggagccttccaggctataggtaaatttaaacatttttctggatgacggttgagtttatctgaagacctgggatcaatagaaaggaaatgttcaggttaagataaaggattgtggagaccaaattttattgtgcagaggaagctctcagatagcagacttaagagagagcaggttataaaatgcttcttatcagacctaaaagggtgcctggctcttagttgattatctcctggatctggagagaaaggaatgaaaacaaagggggaaggggattctctataaaatgtggatttttcccacaagagacgttgcagggcaacttcaaggtatggcaaggaaatatattttgaggtaaaacattttgatttttttccttgttatgccacagtcagattggaaagtaagtcacgatatacagggttaaataaaacccatctgatgaaaatttatggtttgtaagccatgactccccaggctccttagataggaatttgggcaatattaaaaaaaaatcagagcttagtcctcagtaatctggaattccgtttcataacatcaagtgttttaaaccttgaacatttaacagccttcccaaagtcaaacttcagtttcaaaatcgtcttccctggtacatggcttttcaaatacttcagagggcccccgatgtgtccagaactaagagaggtaaacagaattatttgacatgtttaggtacatgggattgccaaaatgatgctcaatcttctttaggttatagctgggtgaataatgccaatatatgttccaaaattgtatgggatttctaaaattctaatgtctgagtatatgctatcaaccataattaaggtttttatgttaagttatagtaaaccacggagataactaaacttctttgtcagtcgtgtttctaattgtaactaccctggaaattttgctattcacagacaattgttgctttaattctttttcagaagatggtttataataagctataggactttgacaggtgctttcaaatacaggcttctgataactttggatattgtgacactgaaatacaggaaaatgtacaggactcaaaagctgaaatgctcatgattatcaagcaaaacaagagttagccaaatggactgaactcaggaagctgaagcaacctttttgacttttgcttggaatattgctaatccatgtttcatttttcagagtcaaggaaacttattttgaactatttacagcctttaacaattgagtaaggtatactcctatgaacaaagtttgaagcgtgtttgtttctctctgcctggttcctctagaatttggaaactatctgtgaatattgttatggcaatatagttgtttgcatcagtgccaataagaatccatttttcttttgcagcaggacacatttggagaaagtagttattttaccaaggttttgactggaatggtatgcttccctttaaggagtcaagctcaacttgcagagccaataaaagccccatggggaaactggcctcatactgttgtctatgcagtccctgtacagggttcctgacctgtggtcagtaaagaatgtcactttctagcaggtccaagagctccaagtttattgtgggaccttaagaggagaggatcacccaactcacaggtatttgaggatgcaaacccatggctaggctcagctttaaaaggtcttatctgtgattccttgtggaaaacatttccatcagtgccaatccaaaaagcctatgtagaaatagttattcttgctgcactttatgcaaataatcaggccaagtgtaagactaaagtctattttgcaaagcactcagtcctaccataatttttttaacaaaaatgaggactggagagacagaaattatgttccaaaatttgccatacatttgtcattaaatgctaaactcattagttgtttttaagttttcatctaccttttagaccaaccctgcttgctcctgtgaaccaagcagcaatctccagctgcagctcagaaagaacaggagggatgggtaatgtagaaatatggatcaatattctagctctgaacaattatcctgcaaaccctgccaggtgatggaataaatagggtgcccattaccaggaggtttcctttttgggaaagtaagaccaagtgaactaaccaaagccaagcatcacgtatccaaatcctggcaagcataactatagctaccagttatctgggtgtgtcacaagacatccttttctctctcttgttggaggagaactgggttccacagcttcactttagcatttgtcttatgataaggaggccatgcaatgccccatccgagatacatttttgtcccagactgaattccaagcttcacatcaaagccttaggaaggaaaatcggatcttagggatccagaggcaaatgacaacagaagttaaaaggcacagcacaggtgagcgtgactgattcctgctgattaagccaaccccaaacttcctgtttcatggataaaggccacgttaatatccatggcataaatgaggtctacggaactccaaggctactgacagcaggggagatagggcatacgtgggtaagagcggatgattcccacccctaggcccccctgcttcatgggtgcaagttgctttaacacccatggtggcacctaccaaggtcactggaacttggggatgcaaggatagaagatggaaagaggatgctcttccctctctacctcacatacctaaggtatctgctggaagaaaagggaaccaggtatgcctgctcccctctttctagatgggtagccattcatcttcagtctgtatccctttcaaatgcatcctgaacctctgggactcctttaaaaggcaccttctttttgcctttcttctcctctgttctctcttcactaataggtaattgtgtctccatactacaaggcactctcctcagatgcatcctccaaactagaaagagttggtttcccaaaccttaaactggttagcttaggattgggctcaggggaaggggacccagaagcccaacgtgccagcaaaagggtaaagttttttttgccagtcaggcttttggcctccctctacgtgtgcaaactggcaaaaggcctcaggatctttgagctgtccttaccctcccttcatttcgttttgatacatagtttctaataacctggtttgtctgttcttgccttcaggccattaaactctaaacaatcatgcaagcagagcctctgacaatggccctttctgctgtgaacccttagatgggcctctgccgtttccccaaaacagcgccccctctcagcaggaagcagttaaggtcagtcttcatccttatccttaatctaaacggcagctggatgtacctctttagagggaggaatgagacagctaggtgggagggggtccccgaaaaacctccagtcagcctgtgcactagagtagagcctcagaaagttcaccatgtttgcactggggaggagcctggtccctccttttcctgtgtggaacctggaattcaagctgtgggcaggaagtgctctatcagggactctagccttgcagaggctcccggttccccctttgtcttctttttcacccaataaaaccttgctcaccctctccaacagtctgcgagcctaaattttcttggccatgggacagacaaggaccctctctttagctgaactaaggaaaagtcctgcaacacctccaacaactaacaattgtttccagtgcacctccattctccaggagggagaaggccaaagcacataagtggagaatgcacacgttagcccattttcaatagtttaatactttaaaaaatagtagtgttgctgactttcaagctttagcatctacacgtgctagattcacttattgactcattaaactattcttttaccaatgagcttaccatatgccaaaaactatgctatactgggaacccaaaggcacacagaaaaactagaagactatttctgcaccagtcaagaagcacacaaatggacactcatgaagaaactatagacccaaagaaaaccattgacaatataggacaaatggcatatcaagtcctgaggaaagagattagtaaggaggttaatattttaaaaaaaatagaaaagggagaaataatgaatcactggaaatggtcccatcaacctgcagttcttcactatttttcaacttaaaattggatacatttatagtcacttgacctctctaggtcccaatctccccatgttcaaagtacatatcctattgctagctctctctactttgctaagtctattgtgaaaatatcacaatataaaatactttgaagccttttagggaagcttaaggtcttctacaaataaaataacaagaagtaccacttggctgaaaaatgaaagaggtaggacaccaatggtagtaaatcacttgtatcactttgttcagaaattatttcatttttttcattttattgaatatagacaaattatagttgtatatctttatgaagtacaaagtgatactatgatatatgtatacagtctggaatgattaaatcaagctaattaacatagccatcacctcaaatacctaccatcgattctcctaactgaatcattgtaccctttgaccaatatctccccatttcccctactcccagcctctgggaaccaccattctactctctgcttctatgagtttgattgttttagattccacttgtaagtgagaacatatggtatttgtttttctttgctagcttagctgacttagcataatgtctgcttggtccacccatgtggtcaaaaatggcaaaatttcctcatttttaaggctgaagaatatttcattgtgtgtgtgtgtgtgtgtatatatatatatatatcacattttctttatccatttcatctcacacctattaaaatggcaataataaaaagatgaaagacaagtcttggcaaggatatggagaaaggggaacccttgttcactactgatgggaatgtaaatttgtacagagctggttcaagggaaatccaagaacatggctgtgaggcaaggaccagatgagggtattaagggactatcattacagtggaaaaattaaccctatcttttttgagagaagccagttacaatgcttgatgctatccctgacacactctctctagcaacaagttccttttctttcggcccttaagtaaggctataagaagaacagaacaaaacagcaaggagatgaataccaaagcactggccacacttttcccctgtgggcctgtcttattccattcatgctgctataaaaaataccacaaactgtgtattttataaataatagaaatttaattctcacagctctggaggctgggaagtccaaggtcaaggtgccagtagattaagtgtctggtgaagtcttgctctctgcttccaagacagtacattgtttctgtatcctcacgtggacgaaggcagaagggtaaacaggcataaagggcctagctagttcccccaagcccttttaaaagggcaccaatcccattcatgacggctctgtcctcatgacctaatcacctcaaaggctccacctcctaatattatcacactgggttgttttttgttgttgttgttttgacaaggtctccccctgttgcccaggctgatgtgtagtggcacaatgtcagctcactgcagcctcaacttccccagactcaagtgattttcctgtctcagcctcctaagtagctggaactacaggagtgcgccaccagctaatttttgcatttttttttttgtagaaacagtttcgccatgttgcccaggctctcactgggtcttatgttccaacatacgaatttgtctgggggatgggtgacacatacattcaaaccatagcagggccttcaataggtcattagagagagagccaaggaacaccagtgtggctttttgcattgaacaacgataagttaatggaagtttaacatagcccacagtctgtagtcagaggtcagaggagtaaggccttacatgctacagatgcccacaaaggagataagaggaagccagaagaaatagaaatttgtttgtcagtggataaagaacaaggccaaggttttcttaaatagtgattgatgaggccctggtttactgtaacagtgtacttgtgattttttaattttgtaaaaattgtcccagtgtgtaattctctgtttatacctgagtgtggggaaatgaattttaaggaaaaagccctatatttcctgataaatcacttctataactaattggttatttaatgattcatctgtgtaaaaagggggactaatggttttaaaataaaatttcatcaacagttgtctctttcataaggtttgaaaacaaagaaaatggagatgatgatgcaggtgtggctctttaacagaacccacaggggagcacacaggctctggggagagcaaacaaggcaagggctcagaagactaggttctaatcccaatgcccctttctcccggatatttaatcatagtcaaattacttaatgaccccaaagtacagtgatttccttaatattttacaaaagaataaaagcactatggacttttcttcaaacagacatatcacccctggcctcaggagtttaatattcagtgactctttggcaggtcgtgaactgcccatcagtcccagtggttgttatgaatgtcctctgctcatccatccagatcccctccccatctttcttcatcctgactcttcctgggagggtgatcaatatagacctgccaataggctcctgcaccctctagcttctaattgcattctgtccacgggaagccctggtgagagttacatcattccaggattgggagcaacctgtaagaggccccggacagctgtgtccatcctctgaaaatgaaggctgttctcaggtgacctgctctacccagatctttttccttccaggttctttttttttttttttgagatggagtctcactctgtcacccaggctggggtgcagtggcacaatctcagctgactgcagcctctgcctcccaagctcaagtgatcccctgcctcagcctgctgagtagctgggactacaggcgtgccccaccacactcagctaatttttgtccttttagtagagatggggttttgccatgttggccaggctgatcttgaatgcctggcctcaaatgatctgtctgcttcggcctcccaaaattctgggattacaggcatgagccacagtacttggcctccttccaggctctgataaatgtttcttcccctcatctcttaaagcctaggggaggttatggactgaatgtttgtgtccctcacaaaatttatatgttgaaatctaatcccaatgtgatggcatgaggaagtagggcctttgagaggtgattaggacatgagggtggaacccttgtgaatgggattagtgcccttataaggggctgaaaagaccagaattctaccccttcaccatgtgaggacacagcaagaaggcatcctctattaaccagaaaatgggcactcattagacaccggatctggacttcacagcctccagcattgtgagacagacatttctgttgtttatgagccacctggtttaaggtgtcttgttttagcagcccaaatggacaaacacagggaggtaagagcccctaccagcccctgtccaccagaaagatggggatctgaacagaagccagaggtgtaactggaatggactcaggtgttttcctcacagagcagataactaaagctagaattcttgataagaaaaatgggataaagaaataacagttgcaaaggtaagaagcagagacagagttatagtccagaggccaaaaggataattttaagaagaaggagtaggtctgaaagtgatgactgagactagcccttggctgtggtgattaagatctttggtgacaatagaaaatgtaacaataggagtggtctgttgtggtgatagaatctgcagaccggtggaagtccatgggcccatttaccatgccacaggcaaagagtatattaaactcccacgaagagaagtgcctctggattcattttgccaacattcactgtactgatattagccatggacttgcagagggtttatttactattgcagcctggctctctgctgtgtctgaaagttgaccttggtgtcctctaagttttatcccagagaaaaagacagcaattgagctattccccaggcacagggggcaaaatttgaaattgacataaaaccaagattccctgtctgacttgggcctctgggattgtattgctgcatcctgtggtggcaaaaagagtatcctgggcagtaagtgatttcaattccacttaaagcaacaagtatttgctgaaaaccaaccatattcttagtaagaagatgggtgctgtaggagacagagaattaaatgaaatcattccttccctccaggagcaaacagcttcatgctagaaataaagctaactcaaatgcaacaaacagaagacacacacacacacacacacacacacacacacacacacagagagagtacttttcaagattagtaacaaagagattatctacagagataaagacagaagaatccaatgtctgcatgttttgttattcatgtgtataagttttctaactttcctacattcagtgtgaattagtattgaaatcagaataaaaaagcaatatttttttaaaagcctaatttttagaaattgatagtaaaaaatgagacagccctgggctgaagtcccaggcgtccttcttcctaacaacttgaacttagccaagttgcttaactacttggtgcctaaatgttctcatttataaaactgggaagatggcatggagaggcaatgggcattttctggcaagaaactaagaaaaaaggccataaccaataagtaacttatggaaatgaaaaaatcttttaagttttataatcttgctttagttgatatcttaaaacaaaattttgaaagttattaagtcactcataaggatttcaggaagcactgcagtgtaatatgcttaagaatggagatggttcaaatgctagctcggctacttagcaatacctgtcctcaaataagttatttcaccctacctgagtctgttacttcatctctaaaatggagataatcctaaaacgtacctcacaggaaccttgtgaagataatgcatgtaaaatgctatcacagtccttggcatggaataagtgtctaattaacttttatatataattataattatcatctaaaaagtttagtggtgtttcagacaaatctaagagaagataagcatgaataggtatatgtctttttcatctttgtatttcaccagtgctttgcacagggcctgtcacaaagtagggatctgagaaatacttgtgaatgaagaatgaatgaatgaatgggctgattttcctatttgatcaaaagccacatccatatatgactaaatctgagtatataaaagaagataaaacttgtgtttcaattcaatctagtgagttaaattaaaagaagaaagggaggaaggcaaattaaaagaagaaagggaggaaaagaagcaggaaagagggaaataagacaaaaagaaaaaaaaaaaaacaaaacagaagttggccaggagaaagggtgtctccatccttaaatattttactccttattgtgtgatatattattttgtcagcttcttctagctacaattcccaaggaagggatagagagcagcagcttccaagtaatgacccatgtgggtataaagagaaatttttatcatattagaaaaaatatatttatatacatgctaccaactttacctagaagagaagagcaagggattggaaaacaaattagcataaaatccctgctccagctttttacacatacagatgttttcctgcatatttatccatccttctgagcactgctcaaatgttacatcctcagagaagctctcctggacccctcatcctgggctggatactctgtcacatgctctaatagtgtctgatacccttccactagaacagggatcactgttgtaattaggtaattatttgggtaattaattgtttaacatctgtgtccagtgtcagtatgcaagcaagctccatgaaggcagtgttcctgtctgcctgttcaccccaaaatcaccaacacttgcatatgccttgcatgaaacaggtaagtgaacataaatgtgtataaggttggcatccattctttgtgcattctgtgtttgtgaatttgcccactcaataaaatgcatttgtaacctcaacatcgatacttgccacatttctgtggtcatttttgggcatcacagagaagtgaaaaatttgtcacccaacatgtacattccccaagtgaagcagaacaaagcaaagctccaccttcttgctccatctctcatactgtaaacaagggtctttttctgatctattaaatgccaggttgttggggtgggttttcttttgcatttttgtacataatggccccaaaagaacagtgctgaagtgctgtctcttgttcctgagtacaagaagaatatgatgtgccttacagaggaaacatgagtgatagaagcttcattcaggctcaggttaaacagctcaggctgtgtcccatgacttcagtgttaatgaattagctatatgttaaataaggcatctttaaataaaagtaaacatttaaaaagtttacatattaatcaattaacaaaaatgttgtgaagaaacagccagtagcacgtgcctgtagttctggtttctcgggaagctaaggtgggaggattacttgagcccaggagttcgaactgcagtgcactatgattgcaccactgcactccagcctgggcaacagagtgagaccctatctcttaaaaacaaaaaaaatattgtaatcagaggctctcaggaactcaaccctggatttcccctaggggcaatggttcattatttgctaattcagcgtttgtggagactttatacaacaatttcctatgaaaaatcaggatcaactatatatatacatagaatgtatatgtgtatatatattttacatatttgtgtgtatacatgcacatgtgtatatatgtatgtttagtagtttttaaccattttggtgttatacacctgttgtaaaaatttaaggaagacgtggatactaggggctgagggttgccacaaagggaggtatgtacatatatacagccctgtgctatgcatctccagggcaggagacagggtgttgacattcacagtatagcctaagtgaatattcctactccatagaattgttcagtgtggtgacacttcatgcaaataaatacatgtatacacatacacatttgcataagattctgggcatttgtggcctcctatcgtgtacctcaggtaaaaatcctgacagagaaataatagatacacaaatataaatatatattatatatggcacattcaattttacttcaaatgttttacataggctaaaattgaaactaaaatgctttgcatttcagccaccaccaacagggactagacaattccaaaatatatgtatccccagaagaaagataatttgttgtgaaacactggctaaagacattccctaaggtaaactaaacacaggcagaaaactgagagttgaaaaaaaatatatacatatatagagagagagatgagagttgaatatctatatgtatatatagatatgtatatatagagagagatgtgtgtgtgtgtgtatatatatatatatatatagagagagagagagagagagagagacagaggagagagagagcacaacaagaatacgaaggttggccaggtgctgtggctcaagcctgaatcccagcattttgggaggccaaggcgggtagatcacgaggtcaagagatcgataccatcctgggcaacatgatgaaaccctatctctactgaaaatacaaaaaattagctgcgcatggtggtgcacacctgtactcccagctactcaggaggctgaggcaggaggatcacttgaacccaggagacagaggttgcagtgagccaagattgtgccactgcactccagcctggcgacagagtgagactccatctcaaacaaacaaacaaacaaaataccaaggttaacctgccccgtttgctttcctaagagtctaagattctctggattctcaggtctgtatggtgggcagcaatgtaaatttaagcttctctgacatctaagttctttggagacagtaactattaaacacctgactctgtcccttgaataacagacatttcttagtaaagcttttaattagatctgttggttgaggatgaaaatagaaagacaccagaaggaaaaaaaaaattcatccctgtaaatggtcctgtggaaatagtaactaaaacaattatactgttaataattcaatgttggtttaaaactatacaattgtgagttatttatacagaccagagttggcatgtgttgtaccacaggtggatgtgaggtcaccaagaaaccacttcacagttttcccagaagtgtagcgtcaaaaaggtcacttgtggtaaaagatcttttggattagtcttttaaatcaatgcatgaattaaagacaatttacatataaataggctaatactctggctttgaaattaaatggatttttaaaagatttaagtaactgcagaaaaggtcagttaggcagtaagtgtacataatgtgattcttgaaaactgctgtcttgttggtttattaatattttgtattcattgtcagtgttgttctaaaattgtgtgcataattagcaatgcaccaaagtcaacggcaggtcccaaaagtaaggaaagcggaatttacaaatcagtgaaggaaggacaagtctagatttggacatgaaaatagtcaaaattaacctttgcctatatattaatacacattagattcaaatatgtcacaacatattctaaataagcatggcatcactcgctccagttaaatttaccttggcatttagcctcactgataaattttcaactcttccaaaatacaaaagctgcagtagtctcctgagttatcacaacaggatcatgattgtaatttgaaatcctgattccccttttagggaacagaaacctgcagtttttccaactgtaatgaaaggatagagcgaaacttccataggatcaaaccacattccattaccaccactcctctgaacattaatgtaccttaaaacatattgaaccataggatgaatatatggagcaggggcatttttaggagagtgaaactattctgtatgatactacgagagatacatgatgttacatacttgtccaaacacacaggactatgacaaaagattgagtcctaatgtaaacgagggatgacttcagttaacaatagtgtagcaatattggttaatcaattataacaaatgtgtcaatccaatgcaagatgttaaccataatgaatactgtgggcaaagggaggggatttgtgggaaacctctgtactgtactttctgctcagtttttcagtaaaactaaatttgctgtagaaaatcgtctgttttttaaaatagtgaaccaaatgtaataatgcactcaaagactctttttagacaaatggtttataaactatattcagaggagccctagtggtcctttgctggccatttggtttaggagtgtttgggaaaatagagtaggagagaagagggaacaatgaagaaaagactgctcaagctggccccttatctttcacccctgtttcaaacaaagcaacaaccttttcacctgtacatattgtttctccacattggagcccagtaaagaagggtttctcagctaaagagaaaaaaaaaacatgaaaatcaccaatgtatgctcaataaagtatcttgctacataaatcagcaactcaaagaagaaaaagttaaattataaaaaccttgctaataatgtacactaattccctcagctacttaataaacatttaactaaaactttctgcctgaccattattacttcctatgattgggctaagcataagctaaatgactaccttggaagaactccaactaagaagtatttatttcacatcaacaatgaaccagtactctgttagaacatgcaacatgctttggaaagacaggtgaaatacaaagcatcattccagctgtccagaagcttatcatcttacaggacagagaacatgaacacaacaaaatgcagaaacaatataatacacctgaggcacccagcacccaacttgatgagctaaaaaatagatttcaggtcttctgtcaggtgttaacaaattgtcaactctgaataatgtgagggccagtatgaatgagaacagtccaatccccagttaagccccacttttctaaatcttcttctctctttaaaaaagcaaagtgaatgctaacgtagtctatcagtaatggacagtgtcctcataaaaagacatatgtaaaaaggaggggaagtggaaggtaagcagtgcttactattttatcatattcaattgtatacacacctcctctcaaaattggtgtccccctatcagtagttactaacaagttagttcccaggatcttgcagatggtgggctggtttcagacaaaggcacagtggtccagaggatctggcaacctctttcaggggctgttgggagatgccctgacggcagcagaagcagcctccaatgaggatggcttcctgctcaagacctcctcacactcctcttgcataaataaatgatttagacaccgttttctcctctaatagccagcactacaccaaagagaaaacactccgctattgatgacaggagagggctttttttgtaagtgtgtatgtgtgttatgctataaattaccctgttggtgggtgtaaaaataaatatccatgtatatagttgtgtatacacacacacacacacttacacagagagaatatgttacagttaaaatcatgctgtcgacagccactcaaatctagagcaatttatggctctcaatgcagtcacacattcaggataaagacaggatgataataaatactttgaatattaccagcataaataaactgcctgaggagcttaaacatttgcaacatagccttgctggctcacactgacaaccagcagacctgttgccagtgagcgactgaaagatcaaacatgattaaaaatgcaaagatgctgcacccaaatgacatgctttatttgacaatgaactctggactcagaggcaccactgcaatctatgagcaaagtgctttttggtaattcatttgcccactgaggccagctactgaggaatcacaatacaagtcccttttaaagtaggcacagttctttacagccattagtaattccatcttgagactgcccttcgagaaaacaatttctttttttttttttttactgagaattgatggtttgtgttttgtcaaaatgagccccagaagttgttaagaacttgtgtaatacattagctatgagtagccgaataatggtcttcaagtaagtacaggaaaatgaatggctgtgatgaagatggtgggcaggtatccttttactgaaactactaaagcaggggctgaagtcaggttttaaaaaagattcttgtgaccataagacacaggaatgtccagtggaagaaagccagttctagcttggagttttaggaacaagccagtttccttggtgtctcagtatcatttgattctatagtatgttatttcttttatttacatacatatgacattcatgatttctttttaaatatccataaattcaaagtggaatacaatgtcacaatgtcttaagtctcagaataagatgctgagaagaccatgaacaagtgatttctttttctttttctttttttttttgagacagagtgttgctctgtcgcccaggctggagtgcagtgggcaagatctcagctcactacaatctccaacccctgggttcaagcaattctcctacctcagccaccctagtggttgggattacaggtgcctgctaccacgcccagctaatttttctatttttagtacagacagcattttgccatgctggccaggctggtctagaactcctgacctcaggtgatctgcctgcctcagcctcccaaagtgctgggattataggcatgagccatagcgcccagacaaacaagcgggggtttcttaaggaagggcttccaagaaaaactgcttacagcgtggcaagaagtagaacagggaaaggcaagaagccaagcgagggtgtgattcagggtagaatcctctgagggacgttttcccaccagaggcaaggaaactgggctttcactctcactcaccaatcactctgcagctaagagccatcctgggggttcctaaactccaagcacttccagctctcagcagacctagtgaagccagcagctccaattggtcctgcaaagaccattgccgaagcagccattggaaggtaaatacacagaagctggggcagggctcacagatatgttgaaaggtaccagggcagtgctccgacaccttctgctacagcaaagaagcaaatggtccaaaaatcaaaatgagggtagaataaggttggagaattcaaaaagtgcagaaaaaaaataaaagtcccccttctctcacccccaccttccactcacccttcacctagtccttctttccaaaggtaacctttgtttacagttttctataaatccttctaaggaaaaatatacacatatactatgtatctatttaaacattctttttaaaaatatgcagattggacaactgttccactgttctactccttgctttttctcactaaagaatatatcttgtattctagatattatattagatctatatacatattctaaatagagagatgatagattagacagataaatgcaaagaggaaggaagggaaggaaaaatggatggatggatggatggatggatggatggatggatggatggatactacacttcattgatttaaagataaaacagttttccacattttaacatttctgaaataggctgtcttatacttgacagcattttagatttgctaaaatgcagtagatagatatatagctatttatggatggattgacagttcacacatagctctgccacttgagaagtagtgcaggatagtagttaagagtatattaacacattgcttattaatgagatactttcgtacttgaggaataaggacctcttttgatggggctaatattttaataatctgataaattgtttattaactttaaattttcataatgagtccgtaaatgagtttgatttatagttttctattctgtgctgtctctctcagactttggaatccatattacattggcttcataaaaacacactggcagtttttttctttatttgtgctatgggcaattttgtttacttttataattctttgactatgtaatacatgtactgtgtatcaaattcaaaaagtacaaaagggcatgagtaaaaaagtatctctacctgtcttccagctgcctagtcccttcccccagatgcaatcattgtaatccgttgcttttgcgttcctttagttatgtatgacacatacacatatgcacaaggacacacacttttactcaaatgtcggtataatagacacaatgctctgcatcttgcttttttttcacttcatgtgttttgtagattgttccataactatacacagaacctccacatcctatctgatgacttcacagtattccattatgcagatataaaattaattttaccagttttcatttttaaatagaattaacattatcagttccttgaaatgcaaaattatttgcttctgaaagcataaagacctgtggctttttaagatctttgataactgcttcagatttttccgatgttattaaagttctctttcctgttgaatatgtttgggtaacttatttacctgtttaaaaaatacattccttgaagattttcagttacttttgcaaaagttctcctttgaatattttaatttctttagccatggttctttttcctttttcctttgttttttgtttttttttttttaagacagggtcttactctgtcctctgtctgtcacccaggctggagtgcagtggcacgatcagggctcactgcagcctaaacttcctgggctcaagtgatcctcccaccttagcctcttgagtagttgggactactggcatgcgccactacccctgtctaatttttgtattttttgtagagatggggtttcaccatgttacccagcctggtcttgaactcctgggctcaagccatccagctgcctcggcctcccaaagtgttaagattataggcttgagccactgggactgtctgctttccattttttgtttttgtactccctaactttttgagtaagtgaatttcattgcttggcattgttttcaaggtgtgttagtctgttttcatgctgctgatgaagacatacccaagactgggaagaaaaagaggtttaattagacttacagttccacatgacaggggaggcctcagaatcatggcgggaggtgaaaggcacttcttacatggtggcagcaagagaaaatgagtaggaagcaaaagcagaaacccctgataaacccatcagatcacgtaagacttattcactatcatgagaatagcatgggaaagaccagcccccatgattcaattacctccccctaggtacctcccacaacacgtgggaattcggggagatacaactcaagctgagattttaatggggacacagcgaaaccatatcacaaggagacagtatttgagcttatttatgattcttatggatttatttttaaattagaaaacctaatttcttatttttatctttattatttagttctttctgcattttttccagttttttggctgtccctttcttaagtcagatgcataattcctttatttttattcttttttaaatattcaggtgttaaaggctgtatacattttcttctaagcgaggctttagctgtagcccatagctcagatgtgttatattttcattatcaatggtgtctagatatttttcaagttgggtttaaaatgtttctttgaattaagagttgtttatcaaagagggttgttgtttgtttgtttgttttgagatggagtcttggtctgtcccccaggctggagtgcagtggcacaatcttggctcactgcaacctctgcttcctgggtcaagcaattcccctgcctcagcctccttcatagctgagattacaggtgtgtgccaccacactcaactaatgtttgtatttttagtagaaacaacgtttcaccatgttggccaggctggtctcgaactcctgacctctggtgatctgctcacctcggcctcccagagtatcaaagagttttaaaatatccagattgtaaggttttgataaaactgatttctaatttattgcattgtaatcaggtaatggggactttatttgtacttcagcttcttgaaatttcctgcaatttcttcataacttataaaggccatgtgtttgtattacattgttttattatttgatatattttgaaccacatattttagaggggctttcctatcacaaacatatttcaaagttgtttgcaaaatattttgcattttctaatcaccataagtgaagtgattagaaaacacatcagggcttctgtggctcaggatttggtgcttgcctcacatagacacaaccagtaactcttactcttgtgccaaatgatgtaattgccctaggaaaatgtttctacacctctcttgcccactttcattgaagaaatggtgactgaatctgaatgtcaggaagggttgtgggttgtggatatggcaactgcaaaactgcagacaatagagatgtacactgcttttgtggtagggacaggatttgagcagtggaaaggcataaataagaaaaagagaaattaattcatgattaagacagattctggcataaagaaattgcagtagtagtagtagtagtagtagtagtagttagtgctgaataccgtatctattttctttcatcagaatctgctggttccatttcatagttcagaggtctcacaaattcaggcaatattcacagctgtggacatagtaacttaggcatattttgcattattaaacgattgatgctatctttaaatttaggttgcaacataacatacatgaaatctgataccaagtcttcacattggcaactagatgggcattgaacacaaaactagaaattgttttatttttataaaatatttaataagatttaattaaagtgtcataaaaatccagctacattgaaatgtttgatttaaatgttttttattagctaacccattcttcattttgctttttaaattctaatgtataattttgaatattgtgcaagaaatatgactttcttaaaaacattaaaaattaattttaattttttcaatgtataattaatttatatgcttgaggaaaatatattcaaattgtatacattttaaatacaaatgcagtttaatttctaattctttagatcagggatcagcaaactttttctgtaaagaaccagacagtaaacattttgggctgttacaacgactcttctctgtcactgccctagcacaaaaggaatcacagacaatgcataagtgaatgggagtggctagagttggccctggggccttagtttgcagatccctgtattagatcataactgccaatagacaaaaagtatcttaaaaaaaaaccccttgattataacaacatgacaattttactgaaatgaagatgagaaaaaataacttaattggaataaatatataataatttaagaaatatttcagtcttttaaaaaactcactaaaatgtcatcagcccaataacagaacatgtacaataataatcaagagctgttgtctttgatatttggtcaattttcaatcacgtaaaaactagggcttcacctatacatttagattttgtccttaaaaaagttatctcatggcagaggataaaaaacacttctttaatggcttactagctggatttgttaatttttaaatatttagacagatggtatatggcctcctttttgccctgggccccataaaccttagatgtaggcctgaatacaacagtgatcaagagacaaaggccctactgtcttgaattacagtctagtaaattctagtgcacatccattgactctaatttagaccagtcaatcatctattctcacatgcactactgcaatagctttttttttttttttttttgagactgagtcttgttctgttgcccaggctggagtgcagtggcatgttcttggctcactgcaacctcctcctcccaggttcaagtgattcttgtgcatcagcctctcaagtagctgggatcacaggtgtgcaccaccacgccctgctagtttttgtatttttagtatagatgggatttcacccggcctcccaaaatgttgggattacaggtgtactgtacccactgtacccagcctgcaataggttttttattgctctctctatatctattcttgccctcaccaacctattttccacataacaaattaatatgttaaaaacataaactatcacctctttcctaaaagctcttcaattgttttccattacattccagattaaatccaaagtcttttatgattagtattattatttttgagacagagtttcgctcttgttgcccaggctagagtgcaatggcgcaatctcggctcactgcaacctctacctcccaggttcaagcgattctcctgcctcagcctcccacgtagctgggatcacaggcatgtgccaccgtgcccagctaattttgtatttttagtagagacagggtttctccatgttggtcaggctggtctccaactctcgccctcaggtgatccacctgcctcagcctcccaaagtgctgggattacaggcatgagccactgcgcctggcccaaagtctttttttataacatatgaaatcttgttcttccctatcttccaactttatcttgtgcacttccttccttgcccagtattatctggccttttattgtacttctaacatattgaggcatttcttgcctcgggacctttgcacatgcaatcatctggctacagtgtttctcctttccctactcctttttcggggctacttttttcatttttacatctctgcttaaacattttcacctccaagaagacttgtaagtccattcagtctaacatatatgattcttgctatattctgtcactgcatcctgttcaatttccttcacagccataggaagaaaacctgtaattctatatatttatctgtttacttgtatatttcctattctgtaaactctttgagagccaggataatttttattttgtttatcacttccagtgcccacaatgcctggaaatcatacatactcaaaagatagttgttaaaaaagtaaatgaatatcaattcatttgttgaacaaataaatatgaaatggataggcacattctggacctatcgaaccattctagcatgaagcctttattcccagagtgatagcaatatcagggtccccccaactaatgattttcaagcccactcagatcctttattcatgctgtatttccaagctgaatttccttcccccacttctctctgccttctcaaatatttatttctttcactaattcaaacacacttctctcaacaagtctttggtacccttttcagccccaaataataggtcttgatttctacatttattatctgaatcattcactttagtatcatcttacggtgcctaattctttctaaatctaagttccttccatagtgtatgtagtagagaccatgtgcacttaatccagccagcagcatggagtggaaccccaaaacatattgatatcattggcagccttagcctgtgttccccatctgactcttacatcccactcaggaaagcagaccctaaacaaaggcttacaactaggtagtttattttgggaaaagaaccctagataatcaaattgaggaacgagggagagtaaaacaggggaaaagggtatcttaaatcagattccctagaagtacactctgaaatgggtacgcttgtacaagaaattgattgaaatagtgccctcaggagaaacctatggggaaatgagggagtaggatgggccagggaagaagccacggaaagatatggcttcagctggagtccagccatggcccaaacccagagtatggacaagagtatggagtatgaacagcaccacagagttattccccttgacagcttctgttagtccttggctgtggactgcccttgaccaggcataggggatcctctaaggtatttctggggaagttcatttccctcaatagagggttaattctcctgagatgagttcagctgtgagaccttagtatccaacactctaagcagctggggcatgggtgtgttgacccactaatggtggtcttggtaggggaccaacagcatcctctacagagggaaatacaatataagtatacattctcaagtcgataacaactacaggcacctagggctcaacctgctggaatcttccgagaaaacttacatgcttcagatgtatatgtataatgtgcttcagacatgtctaaacaaggcatggaagagattatttatccaccaactcccagtccccaccagtcaggggttattccgtgggttaataactctcttatacttccaggttgccagtctcactcccaaggtggtagaaaatagggatgaaaatagggatgcccaatgccacttaggcaagaggcttcaggtcacacttgccctaacctggtttccacagcgacagccctaatacagaaagggagacaagaggatgtgagatgtgtcacaggaagtgtccaatccactaactacttgccctagatctttggagaattaaataacctgtcctactgctatgcatgacagaagccctaccagtgggggctagttggccttcacattggctcctggccttctcattggctcatcttaggtgtcttgggctatctgcctgatacacattttcagttaggcacgtcatgtgaccttacagaccaaggttatgcaaaagagaaatgaaaattaacttattaatcttatgacagtattgggctctctgtatttttctcagggtccctgacactgatggtattatctcattctttggtgatgattatgtgtggaatgtttcatttaaaaattccagtgttgtctctcatgaaagcctgatacggtaggctctatatacatactggtgatgatcgtaatatgtgtgtagcacaaagtagtccctgaacaacatttttaatggcaaacagtgattccttcccccaacaaattaagtaaaaatgataaattcctacattgaaagaaatcggcaaaacagaacatttccttcaattcacataatcattaagaagtatcattcataaggggttagaaacatataatatccaaccttcctgtttaacagagcccagcaaggactcaaatgcacagttcattactgtcattatgagagaatttctgccaacaagttacagtcaggttactatcattcaatcatgttgctaataggactaatttcatggtaattggcatattctagaccagagaagaactcaaatggttgtggaatcattaatgatttatgctttcatggtaaaaatgacaatctattagtttaccagatgctggatcaagccatgggccattaacaggagggtgttctcagaacgttttcagaacaaataccagctactttattttcagcttgcagacataatcacatgcatcccctatcagatccaccactatactgtcagatacatcataaattaaaggctccatgggctcattattggctcttattcgtaaaagcaacacgttgccctggcaagacccaaaatattaaatgggcatttaaagaaactgcaaaatgtgtagttttggaaaaatgaaatcttccttaaaactatttacagtactcaagttttcaaaatgtccttcatcctcgattttgcctcaatatttgtttttttgttttttgttttttaataaaagcaaagaaaaaagaaacaaattcctgccctgtcaggaaagcttttaggccgagtctcttaggaactgggtgtcatttattagtaaacctaatatgctgccttcagaagaacagaggtgccagcatcaaataaacaggcttaaaaaaaaaaattccaggaaacttaatgtacactacgttagtaaccaggacaactcttgtttcccagcaatctatggcatagatacgttggtatgagataaagcctccatctttcctgaatcttcaaaacaaatgtaaagctgattaaaattcctcttctgtcttgcctatgtacaaggctgctctcccaataccaagcaatcctatttggagacaatgggatgtttgccaaaccaaaccgaaataaataaataaataaataaataggagagtttctgttttcaactgttgatggcatcacccttgccatttgtggtgatcagattatccacctagaaagtgtaagaaaacaagtcttccggttagcacttactgggcaaagggctgagtttcaagaatcacaactgaaatcggtggggttgctctttgttaatgggaaaaagcaccatgttaaagtgaccagggcctggtgtgtgcaccgcatgatctgtgagcatgagttgtgtgtgcaacatgcttcctcgtgattaccgcctatacggacagtcactgtgcattagtgcattggtagccagccgccgccaaaaacaggatggcattcttccatcgtgattagaggttttgtgagcattttgggatgggggacactttctcagtaaagactcttccgccccattcacgttcattcagctctttctaggggaaattaaaagctgcagtgataatcccttaaggacaacttggaagagtataaaaggtgcagtgtataagcaattggatgagaaagccttttatgtggaaagttactgaatgggtggctgagggtggtgtgagtggggagaaagaggggcagcttttcttttctaaggtggggagcagcggggatatcatggcacttcagttccctttaatcatccagattcctacgctgtccctgcccctggtgtcaccttgttttgcagtgccagctagctcctccctgccattttcccctcaaagagggagaggggagcaatgcgatttttggtaaggacccagtttctcgctgaatgccaactcagccagctggcaccgaacaggccaagccttcttcagaagaggttagcaaaatccaaattagcatggtccattttaaaaacttgcttttatttaaagactgattcatgacaaacagtggctcccgtactgaggtctggcaccccaggggctggcatccaaccaaacacatgcaactaattgccaccctcggatgacacgcaactaacaagctccattttgaggcagtagattcactaagaatgtaaccccggaaggcagcggaggcagaaaagctcctttcataaccctgtcctaggctaaccatggcagcagagagcctgaaaaacacttttgtttcattgcaccaacaatttagctccacggagggctacaaacacggctaacttgctgaaaagtgatcaagggcactgcgatccccctcatggttataggaggcaggggctctgcttttctctttgctcaaggaaacacacaaaattgcctactatcttgaaactccgcatcttgcaccatttgcaaatctatcgacccccagtacttccccttatactttagttcagatgctctcaggcttcctttgtacaagcaagggctctggagccaggatgcctaggttcaaatcccagctccaccattcattagtaattggcaagtattttaacccatctatgcctcagtttcttcatctataaagtggagagaatattagcacctacattactacgagtaggaacgagtcaatgtaataatgtacataggacaatgcctgacatatcatcactctgttatgaaagctctttgagtctgagatagctcggccttatgaagaaaaaatttccctttgcataagctgcattttagtcaaagttcttgcttccctgtaaacttctagagattcaacctctaagcctttgtttaccattctttctcctctcaactgtccttcctccattgcacagccctgtatgactaaatctcatcatcctccaaaaccattcttcaatgccacctcctccgaggagacttctctgccatcccagctgccatgaatccctgcactcttggcatggccatggcaatttctgcaaacaaatgactgtgttttacttgcctgttatatttccttttctagactgacagatccttttgagcataatccacgagtaactagcacatagtagatactcaatgaatatttggtaaagaagtagatggtcagatgaaagaattgctctgcataaatgagtagctttatactatggttatgctgggcattactcaataggcaggatgggggaatcgtttcttaaggactttcatagttgctttggcccaaattaagagttgtatttaacttgtcatcaactgaggctcataaataaaatctatcaaagaaatatgtcaattaccaccttagtcagcttgggctgccataacaaaacaccaaggattgtgtggcttaaacaacagaaatttatttctcacagttctagaggctgaaagtccaagatcatggtgtcagcagattctgtttctcctgaggcctctctccctggcttgcgtatggctgccttttcgttcaccatgtcacatggtctttcctctgtgtgcttcctcccctagtatctcctcttcttcttcttataagggcaccagttgcattggattaggtcccacccttatgacctcatttaacattaattacctttatttttatttttattttatttatttatttatttttgagatggagtctcgctctgtcacccaggctggagtgcagtggcgcaatctcggctcactgcaagctccgcctcctgggttcgtgccattctcctgccttagcctcccgaggagctgggactacaggcacccaccaccacacctggctaattttgtttttgtatttttggtagagatggggtttcaccgtgttagccaggatggtctcaatctcctcacctcgtgatctgcccacctcggcctcccaaagtgctgggattacaggtgtgagccaccgtgccctgcctacctttaaaggggtaattaaggttacctttaaaagttgtctccaaatacagtcacattagggattcaggcttcagtgtatcaattcaggggaatacaattcaggccatcacaatgacatatacatatagaagcatgaatattctgtatattacttaagtgcataggaggaacttaaccataggaagtccacaagcctttgctccttaagtcctggcatccagatcttcattatgttagcaaaagttcagacaatggaaacaaatgtggcactcaaatacacaactattttatctagatgaaaaattaagctttctttggaatttgtgggattcagttggggggctcagttgcttctctcttagaggcaggaaaacatcagcaccccaggcagcagccacaaccctgtctcctgttaaagccattgcctctcccaagaacaaatgcaaattcccagctaaactcctgtgcactttctaggaggaggctcactttggtccttctaggatcaatttatctgaatcttttcttttgaaggcggacctgcagctttatgtagccctgaaactctgaaccagcttctcatgccagcaccccttctttagtcacttcataattcaaattgctgttatcagcatacactatttgtactgatttgactttttcacattgttttaaatcactaatttcctattaggcagattcctcacatcaataccataagctaatggctcccatggtatttgttcatatctttctcttaagatacttaacactttttacctggtaggaggatgatttatagtcatatgtgtctttcttgccagaccttttaactacttaaggttagaattgcatcaaacccattgttttatcccaaccagtgcttaacatgatatggcacacgtagcagagtcacagtaaaagtttgctgtaattcacatagactttgccaggagtgcatagaaggattaagcatcagaagcaatgcaatcgcaaaggtatctcgtaccatcaaggggtgaggccaacatcttagaaaattaagatcaaatatcatccttcatttttaatttaaagcttctagccagttgacccagaaacatcccacacctccaccatgacttaccaatttgtctgaaataataaagaggaaaatgagaggctattagcgccacttccattctccagtcaatcattgttctaaattattaatcagttgaagtattgccaagaaattttcaggcctctctccaaaagtgtaaagtagtcattttcaagtgaacaattaactattttattcatctagaagttgtagaatttatagacaagctgatttctgtggattttcttccccccttttggatgctggtggaggtaagagaggtctacatgaactacaaatagtttcctttccatcactcacttattaataactagaatcctgtttaaaaggaatgtactaaaatattttctaggctgaagcaggaggattgcttgaacccaggagtttgagactagcctgggcaacatagggacaccctgtctctacaaaaaaaaagaaaaaaaaaaagaaattaaattagctgggtatggtggcatgtgcctgtggccttaactacttatgaagctgaggtgggaggacgccagagcccgggaggtagaggctacagtgagccatgattgtgccactgcaccccagcctgggcagcaaagagatactctgtctcaaaaataaagtaaaataaaatatttcctgaccagttcagcatttataatattgttcctaatagcatgccactcctgactgatcattgctggcaaaagcaaagtgatcgattgtcaccaccctgtttgtccccaggattaacttggtaaagaagtacagccatggtttctgctttcgtggagcttacattctagaggagacagtgaaaaagaaaggtaaatagacaaatgaaacaactacagcaaattttactaaaaaaaaaataaaataaaaaaaggaaaaaagaggctaagataaagaaaggggaggtgtaccttaaataagatgtcgataaagacctcactagcaggaatcatcctccgtggatcaggagaatcctgaaactggggacctcataggcagtccaatccaaagtgtgaataggccatgaacatttttaaaactatatattcagttctggtcatctattgacctcagagacactagatttccagtggcatccactactatgactgcaattgctgaggggtaattttctgagccagagttgtagcatgcaatttgccttgtcattctcatctgatgctcattaatagtcccaacttttatgtaaggtatgtgctttcaaaggtagtgtgatatgtggctaaaaatattgatttttttcttttacacttttgtttcttttaaaaggaggaaaagtgagcactaatttttttatttcaactgtatcttttgaaggttcattatgcatatattttgataatcttgtctatgagaatgaaccctaggacaattaaatatcctttaattttgagatgtgtagtctggaaatacctacatggccgtcctaggctttaggttcattttctttgagaggctcaaccccatattatatcagatatatttacaggtcaaaaggcaagattgaaacaaatttagtttaaagatcttaactggcttttatttgtgattctagaatcagacaaaacctcactgtataaaaaagaatgagtgttccaatgagctgagcagaggaggtttcctttacagctggaaaagggatgaagaaagcagaaacaaagaaccaaaagcaaattggttgtttccaagttactttccttgtaaaggttaaagcagagggacatccttatcatattggctacaactggtctagttgaggatttggctactagttctcccccctgatttcttagaaggtcagatgaaaaacttggttttggcttggtggccaaaacttcagcatgagtaattctattttggtttggactgttgagcttggttcagtagttcagtccaaaccaatggacttctataaattttattcaacatacacgaaacagtttttgtatgtgagatctgtgaaaaatatttttatacttttgcatttaaaattatttgcttatgtataatttggttaatttaattttttaaattgcctaaaatttcccagtaatcaacatgcagtttcaggaattcttaagaactgagaaaagctaactcataaaatgtctctaagagtagacattttaataactattacatttagtaattaatcacaatagcataaaatttcatttattgacatatcattaaatatgacattgttcagattgtgcaatttctgcatacactgaaatcaaagtagtttttctctctctgttagttctgaatattttcataggcccttgaaaaatacattggccctagtcattagttcctggtacctaaagattaaagaggcaatagaatatgtgtgtattcccaggtcttacatggcactagatagtgggggtcttttccccctaaataaagtggatgctattataaccatgcatgactccagttagacccagatgaatgtaccaaaatcactaccatttaaaaagcataaaaaaccttgccctcaatttactgtgatttgcaaactctcctctgaagtttcactgaaccccacttataaatatcatcttgcttctttagcaaattctcaaaccttagtacataagaatcacccagagctcttattaaaaacagattcctgggccctgaccccaaagaatcttatttaatagatctaagtggagcccagaaatcagagtttttaaccttctgaaaccttaaaggttgtataagcctttagaaaacattagttgatgtgagcagggttgatgataacagctggtaagattagtcttgacttgagctactgaacaactcaagtccatttaggctagtctctctcaaccctggctcatactagaatcccctggggcttttaaagcactttacccccaaggattctgatttcttctgtatgggcattggtattttttaaagctaccatataaacaaattgagaaaccctaccagcctaagggcatttctgtcagaaaggattaacccacacactgcggtgatgataaggcctaacactcctacaaaatgcaaacactgaagcagagatttcgcaagactaaaatccatctggagctcttgattcccagtttgtgtcagcctcaacacacccaagttggccttaacagttatggcacaagaaaatgagcccttccctttagttttcatcagctggcagaatgatttagtagctctattataaaagcaactccattataattacagtgtttgaattataaacaaaacaagaaaaatacagaaggaatagtcctttagtcaaaactgtaaaacagaacaatttctggctgcagttaaaagcaaactgaaatattaagagtaagctctccagccctttgattcttgcctctttcccataggagcgacactacacattttttcaattaagcagtttgacaacctgaagaaacccacagtgcatgatttaatgagcatatactgtgtgcatggtaatcggcaagctgacagtttgctcatttcaaactgacaagagagcactacacattagtagaaaggtttcttgggtctcttttcattaaataagctttacagttgaggaacattccaactgtattggcaaagctgtcactaatggtccccaggcaaccttaactctctgtcactctccaagtcctcaagtcttgatgaagaaattgcttcttaaaaaacaaagcacaaaaacaaaatatagatatttaaagttctctggatgttgtcaggggcaaggtggagctttctgagccatgaatccactggtgatttcacagtacatgaattctaacccagtatgtgctggttcttcatgcagatcactttataaactggaattgtttttagaaataatgcccaaactgttaaattattcaatagtttagaaatgattcagtgtactggaaaaaacataggccttggtgacagagagataggggttcgaattctgactaaaatacttctctgtggccttggtcaaattacatcatttctcaggggctcagtttcctaatttatgaaacatggacaataacatctgctttgtatgaacaagatcgtaaaagtctttcgcacagttactgacaacacaggcatacttaaatagagactagtttacccacagaaattcagagtatggggttttaacaaagctaactatagtctgactgtcctgagatttctaccatgagcctttattggagttctataagaagaaaaacagtaagctaacattcactcacaaatgggattttatttaatcctactaagattctgaattttgggtgttattacacctgtttttataaaatctcgaaataagaagggttcttagaggtcatatgaggaatttctgacattttaacttttctgattacaagaatatgaaactactgtttccctctttgctctgcttgtcagaaaactcgagtgaattctcatgctaaatgtatgtttgcaactctgttagcagtagcggttagcagatttgtttcctgattttctatacatatgttagtaaccttacttaaaatagtttataagctaccctgaaggaagttgagatttcttagctaactagtaagatccataacaagaatccatgtcacctgactccaggctaggacacctcacatataacatggaaatgacatagaaaaccccagaagcaagtacagtgaagccatagcttattgcttgggtcctatgccatgaagatgatcaaacatattagccttctagttacgaggaaaaaatatggaagcttcagggtccttatttctaaaatagggataatatatatttctaagatcattgtaaagatttagagagaatattttcaaaatcagccagtgtggcattcgatacatagtaacattttaaaagtctgaaatgttgactctaagaaataattgtagttctactaattacaagtaaaacacaaatgcatagacccttaaacatgatttagaaatcatttatccctccaaacttcacgcactgatgtaaaattctgccccaggctaggtgaagatccatacttgctgtctttctctcatgtcacagagtacatggagatctggaaaagttgtccataaattccaaattcttaatataaacatgtctattggaaatacagactcttttttttttttttttgagacagagtctggctgttgttgctcagtggagtcatcttggctcactgcaacctctgcttcctggagtccagtgattcttttgcctcagcctcccaagcagctcagattcccaagcagcatcatgcctggctaatttttgtatttttagtagagatggagtttcatcgtgttgcccaagctggtctcgaactcctggcctcaagaaatccacccactttggcctcccaaagtgggattacaggcatgagccactgtgcccaaccagaagtacagaactttatcaagaatacacacatgtgacattttcaggtttaataatttatacttcagggtactcacaaaactgggccaaaatcatggtctacctctatgtgaaataccaagtttccctatgtctcacagccatgactccactggtgacttcacagtacacgaattctaacccataaattgactatatccagaatgtagccagacataccataaagatgttcatttatcttcaagggagtccacaaaaatagcactgtagttcctcatatgcataccctaacaaaaatgagtcagtggtgtttccccagagaaaaacgatgctgtgcagtggaagcagctttggaaacagacagattcagatttgaaggctggctctgctatccattagttgtatgacattggacaacatagtatgaacctcttagagccatagattcttccactggcaaatggaggaaacactttgaacttatataactattgtaagcaggggttatgttatgatttaaatgtcccctccaaaaattatgttaaaatttaactgccattgtcatggtatggagaagagggaccatcaagaggtgggaccactgagagatgattaggtcttgagagctctaccttcataaatggattaacatcattatgaagaaagtaggtttgttatcatgagtgagttattataaaaatgagtttggccctctcattggctcattttcattttctcctgcccttctgcttgcctccatgggatgacaagcacaaaggccctcaccagatgccagcaccttgctgttgtacttcccaacttccagaaccatgaaccaaataaatttattttcttttaataaattgcccaatctcgggtattctgttatagcagaaacaaaatggactaagacaaatgatatttaaaatatttaaccattagtatggtaaaggcaccaaccagcataggcttaatgcctgttctggtgcatactaattaaatatgaactccatttgaagaattttgaaggcatccaacttgatcctagatcatgggaggtgcttaaacatatacaacgcattaaatgaagcaaacacgtgttgtaaaacattacaataaaaaacttagcagcagttatactgagatctctatactctccaattacattttttcacctgtgttgtttttattccatgattttattaaatgattgttagcttaaagtgatgagccacttgcgtcttttgactcatgattgagacagtcgtcaaaaaattctagatttgaaaagacataaagtgatctcacttggaattttatcaagtctatattcatgtataatccttatgtcttcttaatttaatgactcctttattatgacacactcttcttctttatctctgataatattttttgtcttaaagttgagtttgtctgatattattatagccactctagacttcctatgctgtttccatggtgtatttatttccatcaatttattttaaacctatctgtgtttttttatttaaaggctatctcttaacagaacatagctgttcttgcttttttatacattctaatcatctcagcatttttttgaatatttatttatttttgtttgtttggtttctttgcccacaaaacttattcattttgtcaatcatttgaaagtagcttgcattcataaagcccttgggcttaggtctttttaaaaaaaattcattcatctgtttttatgtgtttattttttcaagtttcattttagattcagggggtatatttgcatgtttcttacctgggtatattgcatcatgctgaggtttgggatatgaatggtagcattacccaggtactgagcatagtactcaccatttggtttttcaaccttttcccctctcccttcttccctgctctagtagtccccagtgtctattgttaccatcttcacgtccacacgtacccaaagtttagttcctacttacaagtgagaacatgtggcatttagttttctgttcctgcattaaattgctaggataatggtgtctggctgcatccacgtggctgcaaaggacatgattcgattcttttttattactgcataatatcccatgatatacatgtaccaaattttctttatctgatccaccattgatgggcacctaggttgagtccatatctttgctattgtgaatagtgctgtgacaatgaacatgcaagtacatgtgtctttggtagaatgatttgttttcttttggatctatacacagtaatggaatcgctggatcgaatggtagttctgttttaagttctttgggaaatcaccaaactgctttccacagtggccgaactaatttacattcccaccaacagtgtataagcattcctgtttctcagcagcctcaccaacatgtggtttttttttgtttgtttagttttgttttgtttttgttgttttttttttttttactttagccattctgactggtgtgagatggtatctcatggtggttttgatttgtatttctctgatgattagggacaatgagcattttttcatgtttgttggccacttgtatgtctgtctccctttgagaagtttctgttcatgtcttttgcccactttttaatggggttggtttttgcttgttcaatcatttaagttccttatagactccagatattagacctttagtggttgtgtaatttgtgaatattttctgtcatcctgtaggttgtttactctgttgacagtttcttttgctgtgcagaagctctctggtttgattagtctcacttgtcaatttttggttttgttgcaattgcttttgaggacttagtcataaattctttcccaaggctgatgtccagaatggtgtttcctaggttttcctctaggattctcatactttgagttcttacatttaaatctttactccatatggagttagctttgtatatggtgaaatgtaggggtccagtttcattcttctgtatatggctagccagttatcccagcgccatttattaaataaggaaacctttctccattgcttttgttaactttgttgaagatcagatggttgtaagtgtgcagctttatttctgggttctctagtctgttccattggtttctgtgtctgtcttgtaccagtactatactggtttggttactgtagccttgtagtatagcttggagttggaaaatgtgtgcctccagctttgttctttttgtttaagtttgctttggctattcagtctcttttttgattccacatgtactttataatagttttttccagttctgtgaaatatggtagagtagttttataaactacctgtataaaacctgtagattattttgggcagtatggccacattaatgaaattgattcttccaatccatgagcatggaatgtttttccatctgtttgtgtcttctatgatttcttttagcagtgttttgtggttccccttgtagatatatttcatctccttggttagatgtattcctaagtattttatatacttctattttttcaggctattgtaaatgagatttccttcttgatttggctcgcaagttgaacattattggtgtacagaaatgctactgatttctatacattgatttaatgacctgaaactttactgaagttgtttctgagttctaggaggcttttggtggcgtctttgagttttttaggaatagaatcatattgtctgcaaagagagatagtttgatttcttcttttcctattaagatgcattttatttctttctcttgcctgattgctgtggctagcacttccagtactatgttgaataggagtagtaagagtgggcatctttgtcttgttccagttcgcaagggtaatgctttcagtttttgcccattcagtatgatattggctgtggttttatcatagatggctcttattatttagaggtatgttcttcagtgcctactttcttgaagttttttatcatgaagggatgttggattatagcaaaagctttttctacatctagtgagatgattctaaggctttttaaaaatcctatttatgtggtgaatcacatttgtatttgctcatgttggaccaaatttgcatgccagaatgaagcctacttgatcatagtaaattaaccttttgatgtgctgttgaatttggtttgctggtattatgttcaggatttttgcctctatgttcatcagggatattggcctgttgatttctttttttttattgtgtgtttgtcaggtttggtatcagggtgatgcacagaatgagtttgggaggagttgctcctcttcaattttttggaatagttcagtagaattgtaccagctcttctttgtacatcaggtagaattttgctatgacactgctacattttaattagtgattagtccactgacatttagtctgattactgatatgattgcatttagagctgcaagtttattatatgttttctgtttgctcctccacttcttgtttttctttttcttccctctgcaacttttggatcatttttttcttaatttaggattctattttatctttggattttcggtggtttttctaggaattaaaacgtatattcttgatctttcacagtctacttagatttaattttatactatctcatataaaattggaaaaccttgcaactgtataaatccatttgccactgcctccattctttatgctataaagtcatatggattacatctgtacatattacattataaacaccacaagacaatgttataatttttgctttaacaggtcctgtgtagttaaagatcttatcatgaaaaactagtcttttatatttacaatttccaaaattttttcattccttcttgaagacttaagattccatctggtgttatctcactttatagcctgaacaatctttcctttagcatttctgtggggcaggtctgctgataataaatgctcttagtttccttttatctgaaaatgtactaatttgcctttactcacaaaggatatttttgctacacatagaattccggattaacagtgttttgcttttttttttacccctcgtttgtactttaaaaacatcatttcactttttctggcctttataaattctgatgagaagtcatcgttcatttaaagcattgttccaccaaagataccgtgccatttttctctggctactatcaagattctctctttattgctggtcctcaccagttggaatatgatgtacctatgcacagttttcttcaaatgtatcccatttggggttcactgcatttcttgatctatgcatttatgtatttcaccaaatttgaaaatttgggcccattatttcttcaaatattttgttctgtttcattctctttctcttctccttctgagactccaattacatgtaagctagacattttaatttctgttacacaggtccctgagtctctgtttattttttttattcagtcattttaagtctttttttctgtctgttcttccaaaagaaaatttctatggatctatctttaagttcactaacactttcctttgtttcctccagttgctgtaagtatactcaatgagtttttatttcaaatactgtatttttcagtttcaggatttctatttggttctttttgcagtttctgtttactaccttcttattcattatgagtttattttcctattatttgtggagcatggttaaaatagccactttaaaatctttgttaattcccacatttggctcatcttggaattggtctcagataattgctttttgtcttcagaatgagtcacattttattgggtttccatatagcgtgtaatttggggttgtatgatatgcaagtattgatgttattgtatgaagagcttcaatcctgttatagttttctgaagggtattgatttatttgttttagcaggcaattagttatactcaaatttaaaactatcccctgggtagcagctcgaatctcagttcagttcttttatctttgtgataatttgtgtctgctccatcaagaatatacacatgacatatacctcagaattacatgacgtgatctcacttggaattttatcaagtgcatattcatctacaattcttacttcttcttaatataatgatttactatcatgaaatgttctccttcatctctggtaactctttttgtctgaaagtttagtttgtctcatattaataaattcaagggtcaaccagaaatttgggtagtgtttatatacagatttgggagcttcccctctctgcctctcttctttccaagattctgaattcattttcctgtggctatgattgccctgaaccctgttctttgggtcttcaaaccaaaaacactgtgagttttctattggaggatggccacccgaagtgacattaattttagcctgttctcactctaaaagttgtaaaatgggaaactcactctggaccgacctgtgcttccaagttttgaatttcagctcccctccagaatctgtctgcttaattttattctctaatgcttccaggtaatttcttttttcttttcttttttttttttttgtttttggtcttttggtactttatagttgatatctgtgagaatttcggatccagtagaacttacttagccatattggaaatggaaacaagtaaaaacatttaggaaacattcctttgcatttcctaacacctctcctcaaaatacttaacctccgtccattccctcatttagtgacatttgagtttggttttaagtagaaatagaagccaggctcagggcttccttgatcatcttgccaagtacatgagaagacttggaatgaaaacacagcataaagttaaatgatagaatgatagaacatcaatcaattctagctcttagactggtggcatttaatctcaaagcaatgaggcttatacagaatcatgactaccagtgattatctacatggtactttgccacgttattttaccttatttctttggtctcagatatctctaaatcctgcctcattgaaaactgcaatagataatatgccacgagaaacagaatactgaaaatcctaaaatgccaacccagagttggtaattgcacaattccttctaatcataatcattatggcttccacttcttgaaagcttctgtataccagccaccttgctaaccactttacattaattgtcagttaatccttcacaactattctttgagcagttcccataactagcttcattttacggaggaagtaaccagagttccgagaggttgagttcactaagagcacacagcaaacagtagaactctgagtcagtctttgtaaagagaagaaatagcaaaggggttttggagacatcaggcacatactctttactattaggagagaagatagaagtctttctaggagtaagtagggtttctaaaacttaaatagtctacagtcctttttgtcagtaattattgatattaaaatgccacccttccagaaacaatatattttatattgacagcttttatgtttaaaaagaaccttctagccgggagtgatggctcacacctgtaatccctgcactttgggtggctgaggtgggtggatcacttgaggtcaggggttcaagaccagcctggccaacacggtaaaaccccatctctactaaaaatacaaaaattaggtgggcctggtggcgggcacttgtaatcccagctacttgggaggctgaggcacaaaaattgcttaaacccaggaggtagaggttgcggttagctgagatcacaccattgtactccagcctgggcgacagcgagactccatttcaaaaaagaaagccctccttcagggcttaaaacactaacccaaacaataacaaaaggatcaaataattatatgtaaaggctcatatgaaaaggcacataacaccagtgctccattttacctcatttcatttactgcctttaaactttgttttccaggtaaaccatctaaacaggcaggtgacctgccagagaaaaatctggcacattaggaagtaaagatgcctgcctcatcccacaacaagatgcagcaatgtctcacagttctacaactctaggggcaatcctgcccaactttgcaaattttgcataaaccatgggtttcaagtgactttggaatgagagggaaagggaaggcagcacgaaggataagctggctgacattgtaaagtggatacaggaaactgggacttaaccggaagcaggaaaaggaatatagtatctttgtgttctggtacataggattattcaatatacatatttattatacatgttaaattgtctgagacccggaaatgagagatactgttaaaggagtaaagatgagatgaggtaacagaaaaggagaggagtaaatatgagtcctaaggaggggttacatgagcacagtcccctgacgacatgctagagattaccagattagtgcattgctcctactttcttgctattattattattattattatgggttttttttggcagggtctcactctgtcgcctaggctggagtgcaatggcatgatcttagctcactgcaacctccacctcccgggttcaagtgattctcctgcctcagcctcctgagtagctgggattacagacacctgctaccacatccggctaatttttgtatttttggtagagatgaggtttcaccatgttggccaggctggtctcaaactcctgacctcaagtgatccacctacctcggcctcccaaagtactgggattacaggccctttcctgctgtttttaaaaatacatattcaacatatccggtgaaatcattcaaagatgcatacagataagtgattattttactctaacgtaaagcctctttgtaagacctacccttcactgtctgtcccagcatatgccctaggacttcctctgaccatgaacagtaccatgccactgaaggagatctgtttcaacagagcctcctcctgctgctcctaactttatttccattccactagcttctcaaagtcatgcaaaacataacaacctgactttgtaactgtttaaccttactttttacacgtaaaaattattaaatatgtgtaactgctggggggaggataatataatggcatgtcagtcaggtaacaggtaagctacatttcatggaaaagaaggggaatgctttcttcagaaagtgaagtcatcattcttttatttaactgacataatatttataccccaatttttaaaatggcagctacaaatagaagtcgaaagagggtaaattctccaagggaatctagccctgaaattttaccattttaaaagttctattttacaagtacataggaacattactactattataaggatactcacagcaggtcaattatttcaaactctttgaaaaaaaaatcaaaattaagtaaacctacctttcagaagactgctacctcttcggagtcctcagtggcaggatgcacagagcttttatagagggtctaagcaggcaggtattcctaggatacctacaccaaggacaagaaattcagatgattatttcagcagtgatccagatggctctaggtacaatttcattaggaacgttcaccatgaatactgagcattgccacacaggtactgttaaaagcgcagaatgaaggtacatatgtgatttttgcaggcattgtcattaatctgtacattggagactgtggctcaaaagggtgtaagtggttcatacatgatcacacaagaaaaggggcagaaccatgccttaattattcatttctgattcctagtccagggttgtttcagccacatcatctgatcctcctcaagaactggaaagtcctggcactggggctttccattttgcaaaaagatgaggctgacccgtgagtctggtgggaagagtctttctctggttttctggtggtctatgccaagtcacctgtctgaagtgtcctgtgtggccagtttactcactttcccttgaaactctggtgtccacagaatctgaaggaatctgacaagcaaagaaacatgggtttttttggtcccactggcctgagtttgaatcctagtaatgtgtttactacttctgtgtcctatgtagctgctcaacatcactgaggctcactttctatctctatcaaacgggtataataatatttgaagggtacatttatgaagaggattttttttttctaaatgagaataaagtatcaagtacagtttctggcacatgttagatgctagggcaaagtgaaagccccatgacccaccttacttgcagggataaccccaaagtggacaagtgacagggaggctattgagaccttgctgctcataaatcactcaatgacaatgcactaatcccctaactggctggttcctcactgctctgacctctacctctgggtttccttcatgtacacttctttgaaataaaaatatcataaacaccaattcattccctaggatctcatttagaggtaatcgtttccttttttaatctaataatcttggtctacatcatgttacatggtcagctcaatgtagtaattgaaagcagatgatcattcatttaacaagtatttattgagactctactaaggtgtcaggcactattctctatagcagtggacataatagtccaagatcaggccatcatgctgcctaccttctggtagaggagacaaacaaacaaaatacatatgtaaaatacatgagtggttaaatagttctaaggactctggagaaacacaaagtaggaagggagatggtgagtactatgggttgaattctgttcccccaacccctccccatcaggaaaaaagatatgttgaagtcctaaccctcagtacttagaatgtgaccttatttggtaataggattgatacagatataattatttaagttaagatgaagtcatactggagatcggtgggcaggcctctcatccaatatgattggatataagaggatgaccacgtgaagacacagagacacaggggagaaggaacgccatgtgagaataaaggcagagattggagttacatagctgcaagccaaggattgccagcaaatcactagaagttaggaaaaggcaaagaaagattcccctgcagatttcagagggagcatggccctggtgacactttgatttcagacttgtagcctccagaactatgagacaataaatttcggttgttttaagccactcagtatatggtacttagttactgccaccctaggaaatcaatacagtgtgtttggggagattgttgcatttttgagcaaggagatcaggaaagatctcactgaaaaggtaatgtctcagggaagatttgaggtgcaggggacaaccatgatgatggctctggatgaagaaattctaggcagagggaacagaaagtacaaacctcccaggcaggtgcatgtttgtatgttagaacagcagggaggccagtatggctggaatagccaggggagagtggcaggaaaccaggtcagagtgatgacaaggagctggagggtgctagaccttatgggccactctaagaacttaggcttttacttggagcaaggtgggaagccattgcctacttctgagcagaggtgaaccaagatctgacttacattttaataagctctctctggctattcggtaagaataaactgaagaacaaggccacttaggaggctcctgcagttatcctggtgaataaaggtgctagccaggtagcacacaggagagtgaaaactggtcagtcctatgcgaaatattttgaaagcagatccaaaaggatttgcaatagattgcaggtagagatacgcctgacttcttgatagtacatagaattaaattagaaaccgtaacaacttaactgtactgatcatctgaataaattatcttctcaaatgccagaccagccaaagatattagcaacaggtttaacagacagggaataagtaaccagaatatataaggaactcctaaaatcaacaaaaagaaaaaggtaaacaaataaatattttttaaaatcatgattcaaagaaggaacaatggaccatggacataagaaaagcagctcaacctcactgatatggtttggctgtgtccccacccaagtctcaccttgaattgtaactcccacaattcccatgtgtcatgggaggaacctggtgggaggtaattgaatcatgggggtgggtctctcccatgctgttctcatgagagtgaataagtctcgagagatctgatggtttaaaacatgggagtctctctgcacaagctctctatttgtctgctgccatccctgtaagatgtgacttgctcctccttgccttccaccatgattgtgaggccaccccagctacacggaactgtaagtccattaaacttctttctgttgtaaattgcccaatctccagtatgtctttatcagcagcatgaaaactgactaatactctcactaaacatgaggaaaatgcaaatgaaaataatgggattctactttatttctatcagactagttaacatgaaaaagactgacacaattcagtgttgtccaagatatgagaaaaaatagcatattattctagtttacttccagcggaatcatgaattggtatattattctattgagcaattttactgtattatcaaaagtgacagtacacatatgccacggcatagtaactcttcttggggggtataccagggctaagaaacatacacataaggggacatatattaaatcagtataacaaaacttggaaatgacctaaaagtcacccttaaaggcaaatcagtaaataaaatatgctatatttatatgattaaaggacatatggctgttaaaaagaatagattggttttataggcatcagtgtggatgtttcataaatgtcatgggcagaaaagcaacacaaaggaaaatgttaacatacaaacacaatagtatgtattcattgtaggtcggggtccccaaccgccaggcggcagaccagtaccagtctgtggcctgttagggaccaggccacacagcaggaggtgagtggtgggcaagcgagcattaccgcctgagctccacctcctgtcagatcagcggggacattaggttctcataggagcaggaaccctagtgtgaactgtgcatgcgagggatctaggctgcctgctccttatgatgagaccctaacgcctgatgatctgaggtggaacagtttcatcccaaaaccataccccccacctccccatccatggaaaaattatcttccacaaaaccagtccctggtgccaaaaagttggggactgctgctgtggatacacatatatgtatgtaaaagtataaacaacggactagtcaaatacatcccaaatttatggtagggaattttaggcaggggtacaggcagcaaagaaagtggagggtggagggaaggacaggacattattggtgaaaatgatttggttttatcaataacttctttaaaaaggaaaaaaacaacactggaagcaaatctgaccaaacaaaaacagatactcgttttgggatagtgagagtacagatgatcattacactagtttttgtgctcatctgtgcttttttgttttctgcgagtaaagaaaggaggaaagggagggagggatgaatggatggaaggaaggaaggaaggaaggaaggaaggaaggaaggaaggaaggaaggaaagaaggaaggaagggagttaccagttctggactgcacttaagctaatcgctaatcatagatggggatagatgaggttagtttttttgttttgttttgttttgttttgttttgttttgagatggactttcacacttgttgcccaggctgaagtgcaatggcacaatctcggctcactgcaatctctgcctcccaggttcaagcgattctcctgcctcagcctcccaagtagctgggattataggcacgcgccactacgcctggctaattttgtatttttagtagagacggggtttctccatgttggtcaggctggtcgaggttagttttttaaggatgaaactcaaaactatgttttaataatcagcgtgaccattggtgattcctagcagactgtctcagcgtggagggctgaatttcagttcagcccgcagagggaaccatctgtcatttggaatgacaaggagctctctgccaggggaacaccagaacaccggaagcagccatggtcttcactgcatccccactggccctggaaccaccaacactacaggacacaggaacacacaaagtaaaccaagggtacaccatggacatcttttcaacctttttaaaagcacattgcaattttctagaatcaagggaacaatatgcttgattagttcttcagcagatttggcaattttgcttgtcatatttctctctttaaagcaagttggtcattaaccttccatgttctaggacttgagattaggttttccccccacaaaatgaaaactttgcttaaaaaaaaaagagtttgctttaggataattcatttttgctgctaataactgcaagatcctctttgagccaaggaggtcattcttgaaaggggctagaattgtgaagaatgttccttctcttcctggagagagagtctgtgaaggcaaaaaagtttgcaggaaagttcagtaatcatgaagtgaaagcccaaagtgacctgaatacttcctcctgggtcaatattgtatgtttaaaaagaaacaaccaaaccttcaaagaaaaatctggccatccccaaatcccaatacatgaaactagaaggcaggaggcaccagtagaatgctggctttgctctcattgcttggcctccatcacagttacaatagttgcatatcatccttttgtacgtgtcatcctaaaaatgggatttggattggtttctaacaataaaacgagcaaggtagaaaaggaatattatgaataagttaccaatgtaaatatgctattttgcgcctttgaatttgagtgttgataaacatgattccacacatggaaattagacttttcagagctactacactgaatcatttaatttgtctgagtaagtacttataataatgtggctgctctgcactgcaataaacatcgggttttcaaatgaacaaatgaagtatgtgatactccttataaatggaactgcagcaaagggcgttcagctagggagctgtgcactaaaatgggatgggtgataagaacatctctctccagctccactgatagtgaaaggaaagaatcatatggcctctgctgctacattttctgttcctggacagaagcaaggctgaagcctcactgtgaaatgatgggggactgttgctattttgggttgtcacagggtaacttgtcacactactcaggacacatgaggacagataattctgttcctccagattgtggacttgagaatgctttagtaaaatagcacagggatatattttggatagtggttaaggacatgggtttgaatcctgggctctaccaaccaaataggtgcatgattgtacccaagtaatcatcagtcttctccatgctcattttcctatttggtaaaataaggataataactttggcttcctcattaagttattagggggattcagtgagataatttatgtaaagaacctggcacatgattagaattcaccttttttaacattatcattttaacattatcatcacatttttaacattatcattcaccttttttaacattaacataaccattttaacattatcattatatatgtcatcattattattatatttaaccttactttcattttaatccattattcaattttccttcaacgctcattaaaagcacaactcactacattgtttagtaattaattacttttgttcatttaacaaagtatttatactttgttatatgtgccaggcacatatgctaggggctagggtacataggtgatctaatcctcctggaagctattagaggagatgggcatgagtcaaaggctcccataggaagtgaaacctttgaaactcagggaacaggtctaaaagaaaggagcaggctaggcatggtggctcatgcctgtaatcccagcacgttgggaggtgaggtgagttgatcacctgaggtcaggagtttgagaccagcctgaccaacatggcaaaaacccatctctactaaaaatacaaaaattagccaggcatggtggcgggtgcctgtaatcccagccacttgggagactgaggcaggagattcagttcaacccgggaggcagaggttgcagtgagccgagatggtgccactgaactccagcctgggcaacaaaagtgaaatgctgtctcaaaacaaacaaataaacaaacaaaaacaaaggagcagatcactctaagagatactaaaacaaaggaacttaaattaaacctgagacctgaaggatgagaaggagaacaagggatggaatgatggctttcttgagagaaacacaacaatattcaaaggcatggagtatacagcactttatcattgttatcaaaagtcattgcaaaatgatctactgaatagctcaattaaatctaacaactatgtgacaagcacctactatgagccaagcgcagtgccaaactctagaaacaccatagtaaagacagatatgatccatgcctgcatccttacctcccaacacctactactatgtttgaaaaccacaccaaagtcaatatttactttgtaaccaataaattacccctctgggtttgatcacagagagatttcacctgcatggaaaaactggaatgctttctctggtcagacaaggaatgttacatatgccaaataattccctttcttcttagttgctggatatctacaaccaaatttagtttattccatgggcctaccaacttatactactaaagatggccatgtttctctttcatgattaattgttctattatttgtagactacctttaatttagtaaacagcctcagcctcaaattatttggaaagttattagaagaggagaaaaaagtaaaagaaaacaaggaaaagagatctcaagtttcttgagatctgggaattgtccaatgtgctttctgtagtattcgtggtacctaacatggtgctggatggaaagcatttaataacttctgattgtcagatggatgaagaatataaagctttcctggttcaacttgggctccattagaaggagggaagaactgaaactcggtagatcagaatatgcctccccacaacatccttctttagcataaggattattttgagctgattattttgagagactgcagctacaggagaagatctgaaaacagaagagaagttacctttttgtaaaaggattttacatctataaaggaaatttctactcataagggtgtctccctttctataccaggaagagaaggatgaccaaatcactagagactcttaccaatggagaagacaccaacttaaatctgcataacaaaccttactcatgtttaccatacttttcctgggcatccctccacaactgactatcccccatacccttcttttttttctttcagtggacaatggtatttgagcctgatctcaaagccacctctttgagatttattcatatctctgggtatcttccacgtgtacatgagatacacatatttttaacttctgtttgtttttctcttgtttctgggtctatcccaacctaaggaccataaagggtaaagagaaaattatttttccttccctacacttacttttctctagtctccaggttcagaggaaagaactcaaaaaagtggctgaaaagtttagcatgattttcattgtaaagcagcccaataaccaaacagaagcaccacataaaccaaaagaagagagtggtaagtgaaatataaggtaccattagagatttctctcagggaataagattcttgtaacaaaatatttacctttcttattctggtgctagtaaaaataagagaaatgtcacaattttaattaatgtctaagcaacagggaaaaatattaagctactttatgacaaaatggaaatatatttgtaattctatatcctaatgttctctcagttattttggaaaaactattagtcctttggtctcttctacattaggagagcaaaaagctataatatggcctatctggctaactatcgggaatcggagaaatcaatttaaaagaaatttggaagacacctacattatcgatattagagcaaagtagagatctgccttgttcacagcaaagcaatccaattcacacacacacacacaaaacaaatgttgcatttatggaagtattaaaacatctcatccttgtccttagcttaacatattaatgagaatttctgaattaatctccaatcgtgaactgtgtctaggtgtgatataagggcagtaaatactgtgcagcttgcttcaggcatgttttatgacagattctctgacagatagaaaatctttaagattaaattatttctgtattttcctaagaaactcatcagtactaacaagcataccacttccccaactagttgataaacagaaaagaaaatattattaagtgatggcacttgaggaaatagttaaaaggagaaactcagaacataagattgtgattatatataatgaggagattctcaaaatggcacagaaaggaaaggaacgagttgaagctgaaaaacgtatgtttttaggaggtaagttattccataaagcaattactaaaatgtgagagttcttctcatggttctcaaccttatactctgaaagagaacttcttataatgcaagactaagagagccaattacttcagcaccaaggtacatcctaaatctctggacttggcagttcaaaaaaactcttggaaaatgttcttctaaaatcttcactaacagccctgactttagaaatgtagactctaaaaggatgaataaaaactaaccaattagatagcaaaatggagaagagagagcactgaataaaaagacctgccagagttcgggttgtacctctgccaccagcctcagacttagttcatatttacaataaaaccataatcataaaaattaataattatggaacacttagtatgccaagaacttttcatatattatctaatttaatcatcctaacaacctatgagggagacaccacataagagaaaagcagttgaagagtttgtccaagaccacccagctgctctgagtgatgggttaggattcaaacacgatttttttggaccccagagcccaacccttaaccactcactctgcagaatagttcagaaacctcctaggatgatctaaaaggcttctttcaacaatagggcgctaagatttatgagacatgattgtataatggaaaaaaatctcaggtttttgaagtgactttgtagcccagttgagcagcttcttctctaagcctcagaatcttagataacaacactacttaccttacaagctggcctaaggatcagagataatactagagcccttagccccaagtaataataataataataggcagcatttatataatgctcattatgtgctgggcaccatctaaacatttttttccccacattaaagtatgcaatcttcacaatgaccttaaaagtactattattttgtactttttatctaattgtataagaatacaattagataaaaagaaaaaaaaagagttctattgttttgattcctgttttaccaatgaggaaacagaggcaaagagagttaaattacttgacctaaatcacagttactaagttgcagatcttggattctgatccagacagaatgactcactggacaacccaaaacatattggaggcactcctactgatacataaagaacctccttgccatgcccaatgtctgtgtcactctcacccaaagtaacaaatttaacataaacttgggaggatgaaatacatagggatgcccagataacctgcctactgtcattccgcagattgtgcctttaaaaaaaccaatttcaatagaaaccagcaagaaagagatacatcaggtatgtcagacatacgtggtcacaactattttttctccttcctggctaatcactccctttgtgttgataatgtgctgctttaaatcaattcataaaaaaaaaaaaaagcacagaggcaccataaaagtcgtttttcctgttttcaatctggaagaaattcagtctcttattcattttaaaaactattttaataatagcttttacttaacccaatatatcaaaaatattatttcaacatgttaataaaagttaataagagattttacgctaagcattcaaaattcagagtttactttacatttaaggcccatctcaaatcagactaacctgattagtctgaatgctcagtagccatatatgttgctagtggctaccatattagacaacacagttctagaaagattggcttagaaaagccctggttgttgatatttataggtctctttccttgggctggtcaaattccccagaaagatatctttcaatctcctgccttaggggtataagcctgggtgccattgttctgagatttaagtatgggaaagagcagaagccccatcatattgtctttcacttaagccccgattttcatcattatacccatcctcagctatgcatggtgactccaatcacgagccctgtagttggtccaacccctccagtcttcctcctggggaagtagggagggaggcagttgggagaggcagttcccaggctatgcgggttgggcaagaactctggggactggttagcagttatttgtcattctttcaatgttcttttaatattccttcattcccactttcatacatttacagtgccatgaattcctgacacgttctagaatctcagtttagattttaccgtttctctccccttttaaatcagtccctggccttttaaggcagcttctacaattgtattctgtgaccttctcctctatgatttttgttcatattcccctccccttttttaactaacattttttatttgaaataattgtagactcacatgaaggttgtaagaaaaaatacagagaaggtccatatgccctttatccaattcccttcaatggtaacatcttggaaagctattacacagtaacacaaccaagatattgacaatgacacattcaaaacacagaatgtgtccatcccagggatcctcttgttgctctttaatagccacacccacttccctcccactccaccccttcttaacttttaaccacaaatctgtactccatttatataattttttcatttgaaaaatgttatacaagtggagtcgtacagtgtgtaatcttttggttttgtgtttttttcccctttaatctattccctgaagattcagtcaagtagtttcatgtattaataattcattgctgagtagtattcgatggtatggatggaccacagtttgcttaaccattcacccaataaaggacatctgagttgtgtccagtttggggctattacagataaagctctatgaaaattcatgtatgggctttggtgtgaacataagcttttgtttacttgggataaatgcccaggagtatgataagtgcatgtttaattttgtaagaaactgccaaaccattttctagagtggctataacattttacattctcaccagtaacacaatttctctgcatcctcaccagaatttgttgttatcattatcttttattttagttatttcaatatgttcatagtgataactcattgtggttttgatttgcatttccctgatggttaataatgttgaacatcttttcatgtgcttatttgccatctgcataacctcttcagtaaaatgtctggccatgtattttctaattgagttgcttggatttttttactgttgagtttgaaaattctttatatattctaaatactagtcctttgtcagatatgtagtttgcaaatattttcttccagcctgtagttattcttttcattctcttaaaagggtcttaggccgggcgtggtggctcacacctgtaataccagcatttgggaggccgaggagggtggatcttttgaggtcaggagtttgagacctggccaacacggcaaaagccagtctcaactaaaaagaaaaaaaaaatacaaaacttagccagccacagtggcatgcacctgtagtcccagctattccagagcctcaggcaggagaattgcttgaacctgggaggcagaagttgcagtgagccgagatcgtgccactgccctccagcttggggaactgagtgagacactgtctcaaaaaagaaaagaaaagaaaaaaaaaaaaaaaaaaactctttcacggtgcaaaagcaaaagttttaattctgatatagtccaatatatcaccaatatatcatttgtttcctgttatggattgtgtttatgtgaaatctaagaactctttccctagccagagattccaaagatttttctctaatgccttctccttctaaaagaagggttctttattctgttccgttgatctatgtttctgtcactccatggatagccacatagtaactatgcaatacttcttgaaactgggtagactgattgctcccactttattatttctttttcaaaattgttttagctactctagttcctttgtttctgtataaattttagaataatgtcatctatatatgaaaaaaatcatactgagatttttgataggaactgctttaaacctgtatatcaatttgggaagtatcggtatctttactacgctgtgactttcaaatcatgaacacaacatttttctccatttatttacatttttaaaatttatttcatcaacattatatagttttcaacaaacaagttttataaatgttttattggattcacataagtatttcatatttttgagctaaggcaaattgtactatatttttaaaatttgtgtccacagattcattgctagtataaagaaatacaattgataatttaaatgtctatctcatatcctgccaccttaatgaactcaattattagtttttcatttgtttgcttgagatagggtctcactctgccacccaggttggagtgcagtggcacacaggtattggcacaaacacaaccttctatagcctcaacctcctgagctccagccatcctcctgcctcagcctcctaagtagctgggatgacaggcatacaccaccaggcctggttcatttgttgttgttgaggagagatgaggtctctccatatttcccaggctggtcttgaactaggctccagcaatccacctgcctcggcctcccatcgtgttgggatgacagtcatcagtcactacacccagccacttactagttttaagagttggttttgtgttttttcgtctttgtagatcacttagtgttttctgtgtagaaaatcatgacatcagcaaatattaacagttttctttctttccatctgtatgcctttcatttccctttcttgccttattgcactgattagaacttcctgcactatgttgaataggagtggtggaaccagccttgcactgctggactagactccatttcgtcgtggtatattattcttttagcctgaatcctgtttgttaatattttgttcaggattgttgtgtctctatttatgacagttattggtatatatttctcttttttgcactgttttttctgtttttcatatctgagtaataccagcttcctaaaatgaattgcgaagtgttctctcctattttctggaagagactgtataaaactcctattaattattctttaaatgtttggtaaaattctccagtgaggccatctgggcctaaatatttattttcagggagtttttaaatgattaattcaatttttaatagttatgggcttttaaatattatctatttcatgataggtgaatggtaggaatttgtgtttttgaggaagtggcccatttcatctaagttatcaaatttatgtgtgtagagttgttcatggcatttctttattatccttttgatgtctacagggtcaatagtgatatctcctctttcattcctgatattgtaaccaaatgcaggtccagatgcccactgtttacagagtccagttaacaagagtgaggtctagtagaaagaaagtcattttactaaaaccagtaaaggggaaatggtcagattcccgcccaaagcaatcactttgattttgggggaaggcaggggtttaaaaagggaaaacttgataaggaaggcatgcaagaattgtactaagtataatatctgtgtgtcttgttctggtagctatcttgggtctcagtctacctggatggtgagtcaagacatctgggaatatctttacttcccctttattcctgaggatattttcacgggctgtaggacactgctttgattgttgattattatttcattcaggactttgaatgctttaagttcctgagcagccatggccaggtttttaactagccactttgaagtaatctctggaattttgcagctgggtctccaagcttattccgcctgtctcaagattagcccctggaacttctaagaaggcacagtaattagatactagtatatacttagacaaatgtgaagggagtatatatggtgaaaaagggagggacgtggagcctatttctaggctgaggaaaaggcttctgcagtttttcaaggttgtatcttgaaaaccaagagaagagaaaaaaatgttttaaaatgcatttggaagttaagttgcctagttacaatattggtaattggtgtcttttctcttttctttgtcagtcttgctagactgtcagttttattaaccttttcaaagaaccagctactcttgttttcctttgattaaagtttgcatgatacatcttttcccattattttactttcgtctattgttatattgaaagtgagcttctcatagacagaatatagttgggtcatattttttaaacaattctgctaatctcttccctgtattataagtggtatatttagaccatttaactttaatgtaattattgatattttagaatttacactgccattttattttttgtttattttctgtttgttctctttgtggttttctgttttctttgcccagacttcttataagctatttgaacactttttggaattctgttttgatttatctaaagtgtctttcagtgcatttctgtatataattttttaaaggtttctctaggtattactttatatatttataactaaacagtttactggtgtcatcattttaccagtttgagtaacatatagaaaccctatctccgcactttgcatccctttatcttccccatttataatataattattttaaatacttcctttacatgcatttacatccacatcagaatattgcaatttttgcttcaaacttcaaacacaattagagctctcaagagtacaaatgtttttgctatgtttttttcttcctttctgatgttgaagagatccatttttaattgtcttctttccaattagataactcttttcttttctttcgaggcagagtctcaccgtgtcatccaggctggagagtgcagtgatgcaattatgcaaattcttttagttttccggctgggcgtggtggctcacgcctgtaatcccagcactttgggaagccgaggcaggcggattgcctgagctcaggagttcgcgacgaacctgggcaacacggtgaaacccgtctctactaaaatacaaaaaattagccgggcgtggtggtgggcgcctgtagtcccagcgactcaggaggctgaggcaggagaatcgcttgaacccgggaggcagagcttgcagtgagtcgagatcgcgccaccgcactccagcctgggcgacagagcaagactccgtctcaaaaacaaaaacaaaaacaaacaaacaaacaaacaaaaaacacaaattctcttagttttccttcatctgataatatttttacttcccctttattcctgaggatattttcacaggcaataggatactggcttgactgttgattgttatctgcattcaggactttgaaagctttaagttcctgagtctcagcagaaactcaaaaataatacatgtaggaagagctaaaaaaatatacaataaaccggatcctatcgaatttaaatgtcaccaggctacaagaaactgattctggcagaaaaaataaacatgtgaaaaataattacaataatgtgtgataagtgcaaaaatgcaggtatgtacttgtcacgatgctgacacacagagagaatcagcactgcttgagagaatcagtgaaaacttctcagagatgtgtgaaccaggttctgaaagttaggtagtaaaaggacttcctgggtgaaggggaacccagcacgaaagccctgagaaaagcggaaaagatggtacatttgagaatctgtgagactgaatgcctggctgaggtatagaacacccattggaacaagcaagagatgcagtagaaaagacagctaagggaaggatgctgggctagagggcctcatcctctactaaggagtaaactttatcctgtgtaccacgaggagctaccgaacagacgaaaatggtgagtgtaatatttaaagcaatgattgctactataacactctttttaaagtagcttttccatgaattattaacattatctttagtctaatacgtatcaaaatttagtttatggactggtaggatgtgttaatggccaataaaagtaaaagactcagccgattccctgccttctacactccattttacacacactccatcctgcctgccgaatgacttcagtgtctctgtgaccagtgagtgaagcagcatgcaatgagatcatggctagatggcagcacattcagtgaagtgcttcagctttcctgttgcttctgattccctggcatttgtcagtgtctgtcaaaacattaacatttcttaatgtatattttgcattatttactaaatgaaaattttccaatgacagtggctgagaaaaaaaaatcagatttacatacagtatgtcaagttcacattcgatgccccagaaatgcccagtccccaaagacctctagggactgcagctcatttgttgtccctctccctctcccgtttattatgctgaccctctgcccagccacatagctcaccccacccccttagaagcatctagagttggctctagacatgaaatggaatagatttctgcatttacataactgctatcgcacttctggtgaaaagtagtttcagaaaaacacagaaaaaaataaacagaagaataaaaagtgtctatgtgataacataagggcttatttaactacgtctttatttcctttacagtccaactattttttttttaaaactgcatgccaccttcatgctgcctctcggaggggacttgatcttatttagacccggtggcgagggtccttcagctccgtgaggagctctctagcactcagtcctctttagaggaaagatatcttcagagcctaaaggccttgaaagaaatgacacatttttaaaaacagaaaaacaagcatgaaagtggcccatcagaaatgaaggtgtgaactagaatacaatagacagcgaggaaggagccaaaaatcctcacccaggcaggccaggatatatgcagatagggaggaaattgggaggcattcctttgctaataaagatgatttttcttctaattttcacatctttcatgatgtatcttttgttttttgttttctctctatgactgctgttctaaaataagtgggctttaagaatatgaactacagtccgcatgtttgccagccccatattctgcgatgaacttgacatgtgaatgaatcaattctgcagaggtgaaaagttattcctacaaagtccccagttttccttgtgagaaagatccctacttacctgtaaacttgttaattaaatgtcaaaggtttttatatcaaggacaataacacaagccaacctgggaatctgcttgtctgaaataggtaaagagtgtctgtgtttatttagaattgattgtacactttccttcattctctacatagattttattttctccccacattcttctttttctgtattgccttgagggctttctcttataattatgtgacaaattatatctgaattatgttcaaataagcaaggagactgaggttttctgttaaaaacatatggcctatcagtaatgaatgaagttttgcccatatcatgacatgactttattgaaggcaccatctcatatatgcagttttcaatgtggtgtctaacagatttgtgtaaaatgtctaaaattaagcaaatgcaattatatgagttagtatcatcttatcatgtacattttgcttgataatagaaaagcaaatgaaaagtttattagcttattacaacagtctgtttttgatttttactttagactctattcctctttattttctcctcttctgtttcgggtcattattttatctggagaacccaaaatccaattcttcatctgtatttaccacatagatctttagattctcttaccaatccaacagatttctgaatatttaactaccctattgtaagttgtcttgtttagaagaaatggaatctaagattgtggcagtaaaggacaagctgtcaatgtgttaaataaattcctgttgaaaagtaacggcatgcactgtgtgttaacataatttattagaacaattagaacccatccttgttgtcttttaattagattattccctgttctggtaattacactagacaagggagaataatagtcttgggattctaaaatcatctgtagactatgtggaaagagaataaataatcaataatgctaatgtaccggaaaacttaaattcccagaaagagatcttttatcatgagcaatcctttgtataaacagcattatttctcaatgtctatgcttatcttgcccaaagttgaaaagtgaagacactggacaaataacagatatttattttactgtcagaaacctggttgggctgggccacctctggcctctagtggctcagacattgcttcagtcccttgcaaaatgccaacaagaaaccgcaaatgaaggatttaaaattccatgcagagcagcatatctagcagtctgaatgcctaagggaaaggatgcagggcttttaagttctggtcctaggtgaggaatcataaagttcctcaatttaaaaaaatatatacaaatggacaaaaatgtcttagaactgagaaggctactaaatattaaaaaaaaatttctgatatttccatacatgaagatgttatttgcagaaattaataggcaggctgtatgtcaggaaagtttctggctctcagggatgggctgaggcctttagatgtgaatcgaactacatctctggttttatgtttggaagaccacagggaattccagtgctccaaggacgctccgagggcctacacaactgtcatcaagcatgttaggacatcctagagagtagttcccaaaacttctaggcttcagaatcttgacaaagtcatgggtgggcatatcctgccctcacggataaccctacagttgagtagaaggatgctggaatgcacagaattgacaccagtgaatctggagttctctgtagtaatgagcaacacaaatatctcaccaacagtcccactgttatccgagtctgccttagtcaatgtaaactcctaatgagaccatgtctagacagtattgatctcccaccagaaaaaaaaaaagaactcagagtgtgacttcttttctagcttagcccaaatgacaccctaaaacatgctctttcattcactcattgctaacacttttcataacctgagatattttatcaactaggcagccaaggacccataggcttcttcgcaaggtatatgtgatattttttatatttaaaacatctttgatattcaaatagcagataagaaagttacttaagcttattaaagaacctagagaaattaaatgagtgtatatatatatatatatatatatatatatatatattttttttttttttttttttttttttttcccttgctaggcaaaggagacaggcctttaaaaaatgaaagtccacataagattaaggtgtgatcattcaagttaatgtgggcaagatatctaaaggagaaatcattagcttaagctatccaaaggattttacacacagtcctgtggtttaggagcagaggatcacccgtactactgtgctatccatcccagctgggaagacatggttctttatagaagtaccccttaaaattgtcaggggtgctattaagtacttagggttccccactattcttatctccagactggtcaaatctaccaggcatctttctgatatatcagatagatacaatctatcatagatataccaaagatttatttgcatctgagtgtcctgtggtgaggcattccacagcaggctgtgcatcaggtctgtctgcagaaagtaagaaagaaaggaatacagtttaaaattcacgtaggaatggagtttaaaaactccccaggcaatgtgaaggtgagttaggactgggaaccacaagctaaaaaggagaaccacagagaattctttctgactttggggctgaaatgaagctgaccgaggcattcaggtggttccagaggctggaaagtctcatacgacaggtttttttctcacaaaagagaagtgaaataagtaccttattatgttccaacaatatcaagatacaaatctatcttttagaaaaatgctaaataaaaacacagtcagagagagacttccaccactataaatagtttcttataaatgccacctagagacaaaattatcatttctatgatcctaaccaaaagagccttgcatgtcttggaaatactttgccctctaaagcaaccagaagaacattccttcagtctatgtgttcttgtgctggattttgaaacttttgagcatttgctcccaaagtgaaatttaaaaggctaacagcagggacacctggataactagaaaacttacctattgatatcacaggctgcttctccaaatggactgtatataatttcttgcaagcatagtaaaaatcctatacttgcttgaaatgaaatgaaggaaagcctatcatgaatttctttttctctgtgttaatgaaagacacgagcacaccatgataagcaggagagaatgacctagtgttcatccttctcttcttgtccaacgcaggtaactataggtgggctctgggtagagtatatgattgctgcatatttctaagaaataaagttaatttacaggctacctcaatcctgacactctaggggtaaggcaagcatgcatgtatgtatttctggtaatcaagagggagaaatagcagtgaaaaatagagcttggatatatatcttaaagacatgccactgatttcaaaatagggcaagagcacttatgatttaatataattttgttggaaaaagttaactctctccaaggaaatacagagcttagcaaataccttataaataatacaaaggcatactatagtgtttagtagaatcttattcacccattctgatttggacaaatgttaaatgagacaaacaggagaaaagtttattgattaggtaaccgattaaaattttggtgaaaagcagaagtagtaagttccagaaacaagaaataaatcatgtatatcaacaagaggaatgaaggcattttgtgcaatcctggggaatagattttcttaggtatttcataaaatcattgactctagggcaggaaaaaaccctacacacataaacccacagcattctttttcctgcctccacagttgtaaaggcccgatgataaaacctgtttcctaagacttccccagaatgtgattcaacacattttctatttttttaaaaaaaaatttctgccacttaatttcatgtgataattttccccaatgactaaccaaatatgcttcactattatataaatcaattctttcttaatgccacaagtgaaagtgcaaaggtagctaatggttttcttctcataaaaatcacactttggctttttcctttcatatgtaattaatcatatttgtgacaatcttccaaacttacttgaaatttttctgaatccctttcaaatcaggacaagaactagaaatgtctatacaggtttaatatgaagtaaagaaaatgtttttcattttcttgatttatttctgaattcagcttgctcttcattagcgctacatagctgmcttattattcgtggtcccctatgaccccctgatcattttccctgagggtgcatatttattcactaactatgttacaatcatgtgatctgctggattttttctgatagtctactctagatttgttctaaattaataaatcccattatttttggcttctactacttctatttattaaattcattctgaatatgaagtttattttcaaaggaattcataattctttactccrrgcttggttctaacaatgaatttaataagaattgtatttaatcaatgtttaaatatattaagggcaaattttgtaaaaatgttagtgttccaagctttccatttccccacaaattaatttttttagcctttccccttaatccactttcttaaaaaataaaattttttttgtgatgcagaattatgtgaacaataagaaaaaaataattagaaaggtaggagtaaactaaaaacaaacaaacaaacaaaaaaaaaaaccaaaaaactaaggctgcagacttaatagaactaccatagctacttaagggtaaatgattaagagagagacaacgtctggcttctgagcagagcacagagagaaagatcaccaggaagaaaaaagataacagggaattttaaggacagttgccatgtgtaatgcataaaatagttttcaaaattcttggagaggtaaaaataaaatttagatttattttttaattatttcacttgcgatgctatcttaagattgaaccacatggggccccagaatttatttaggttatacaaatatcctccaattctgatgctgattatttcatatgcagacttcagttacctttacatgtcataaacacacataccccagaaataaacttgatcatcccataaattttcaagagctctcagcctgctgtaaatgaaatttcaccattaactcacaggtcgatgtctgggacaacctcaaagactgcttgagtaattaataaatttatatgaaaacattggagtgaaaatgtctgtcagtgtcaaatacataagaggtaatggctgatacatagtaatgcagttttaaaccattggcaacatatctaaacaaaggtatcagagaaaaataaaagaaaaccttgtaacttgtatgataagcctcttgcataagattattaagaaagtcataagcacttacggctttattccttttctatatagatagattgcccagaaaaacgtggactgaacctcagctggaatctgagggctctgcttgtctttaacagcttagctacattgttagagagcaacactacataatacagcatgccctattcttaaggcaatacataaaattttaaaacctgaagctaaattaaaaggttatcacccttctgcctaatgtattatatatttgtaaatgatatctgtctctaaaaaagatgtaccacaaagcaagagcatatgtgaaacaataagagagaatgtaggagttagaaacacatttaggtatgtaggaaacacaaacttcaagacattcccaaggatctaaataacctatacacaaatatagcaaagtcatatcctaagggagaggatttgagttctaaagccggagcctaaggtaaatgttgcatatagtcaaacttaccattgaagatcactttaatcacctgtagggtgcaagttacattgctttgtgtattcaagactgacagtgaatatttgagaaaatcagttgagttagaataaagaaggaagcaaagaaaagtccacctacagatattagggtattcaaacaacctcttctttaagaaactagcaaatctccacctctgagtttttatcaggtaggtgatgaagtgcaaagctgtaaaccctccaacagggcttattccactgttttaatattcacatttcataacttggacatatgcattaatggatgtatttgtcattgttaagattaagtaacataatctttctttttttttttctttgagatggagtcttgctctgtcgcccagcctggagtgcagtggcatgatctcagctcactgcaacctccgcctcccaggttcaagcaattctcctgcctcaggctcccgagtagctgggattacaggtatgcaccacaaagcccagctaatttttgtatttttagtagaaacaaggtttcaccatattggccaggctggtcttgaactcctgacctcaggtgatccacccaccttggcctcccaaagtgccaggattaaaggcatgagccaatgagcctggctgataaccttatttcataagcaaaagcatcatccacagggtctggtccagagcagatactcaatagggtgctacattttaatctaactcttgtttcatcagacccacaaacacattgctctttaaaatcctgtagagaagaatatgacaacctgcaccttttctttccaagatggcatttccagttagggtacctctgaacagctgttgcttgcacattttaggcatggtgaagatctacacctgatgctgggttcctaagtgggcatatggtgaatccactgcacacagaagcacttctttatgcttggatcacattgcagaagattggacccctgactggggctacctttcccaagccttaacagcacatcaggctcaaatcacagggctatcaaatgaggagatccccttttccaaaaaaagcatccctatcaactctcccaggaaagcacatgaactcatgttatccattcattcttatcttggaaaatacacccacaagccccttttactgccacttacagtaggatgccacaaaaattcagaaactggaatccttttccgtcccttctcctttccttcctccctttcttcttttcttcttccttaccttgaaatttctgcctgtggtaaaaccacaggaagaaggaaagtcaaatgaattttcctattagtcgacatttctgtgatacactcattttttttggtccccgtatgaactccctccagggtatttctttatgggaataaagtatgccaaatgaaataaagaacttgaagcacaattttatccttgacatatgtagagagaatatgttactcctgaatttatggtgcaatgcaactcagtcacttccttttcctctttcccctagtttgcacttcctacttattgctgcataccatcacaaatttatggagtgccaatggctgtggcctctaggcagctcccaaatgactgaatccagacatcattgtcttcagttcccctttggcattagtctattttccatccctcttcctttattgaaatctgcttccaattatttttcataagatggtttagctttcttttatttcctttaagttgaaactcttttatttctacctttcatttctatgccctcctgggccttaagcacagttcttctacatttacaggggttttcatttagaaactattgagaactttactatcaaattgtactttttaagataatttttttgcaattttaactaaaaggagatttttagacttttggaaagtcatggctccaggtctcagatctcagctgtaggttttatcactttgcaagatgatgactagagttacagcacattctttcaacccatgcccaaaacttcaaagatggccacccttcaacccctgaagatttcaactcagtgttttcagaaaattggaggtccaggctttggagtcagacagatatgggttcaaatccagcctctggcacttaatttgaatacaacctagagtaagtcatttaactttcctgagctttgatttccttatctgaaaaataagaatatagatacttacctcaccatattgttataaagatgaaatgaggtaatctttgtaaaatatacacaatgtctagcaggtggtaagcattcaaactggtagctattttttattgttatgagttaaaattttgtatataatggattttttttccaagaaagctcatcaagctgaccttaagtagatgttactcccaaataccacccaattccatgtctacatacttgagaagttactaaacactttaaaattgaaattgaaaactagggacaaacatagatttgaaaccaaaggaataggtaatcagttataaatttggatataacattatgagcctctatttcagaaaatacattccttttaaagtatatttactatagttatccatgcagactgaatatttttatcaatagttgcaaaaccatttcctgaaagggaaaaccatgtaattataactagattttcacatgttaaccttttatataagggaagaacaagaagtagatatttgctaagagactgggaagaaagggaagagaagggagagagggagagacagagagaatgagaatgaaagcaaagaaatttgacaaggaatactatttggcttttggcccttccgtgtaccaacgtagatgtgtgattataccatttaggattgttgtcaattctttccataggaacagactgaacaatgagacatctacctctcaacccaaagagaataaaattgtcatttccctacaggacttttgttaatacaaaaatgaaatatatatatatatatatatataaaattattatgatttcaaaaataaagccaaatatctaaatgaaaccatgaaaataattagctccgatccaacagagtaagtgaggtttttactttggaagataagtaaattctttcagagcatgagaatgaaaaattgattgattccgatctgatctctaaaaagagcagtctgatttactttggtatcaaacagacctgcttctaaatgccatttctgccatttacctgttgggcaaatttcttacctatgcacttggagtcttcacccttaaaataggtatgaaaataggtagaaaataggcttgccatgctttctctctctctccctatatcccatgtctctccaaggagcaattcctaatgtaattgatcaaattcaagcatatggagtcttatttactaagtggcatggtcactatacaataaacgtgacttcccccacttctacttcttctcttctaagttgaaaaaactctaatctctcaggtcaggctaactatttccttccctctttcctgccttctttctaatttgaggcaatagcatccatgagcccaggcgatgtcagggattcttgtttttatctcaacactttcattcttccccatcccctcacaggcccccattcagaattcttaagcatgctatttgcttgagggggcatttaggaagtcccatttaagacctctgccagctctaatcttatctcttcagagaggccttcgctgactatccaatctaaagtacctacctttatcagtgttctacactggaaggtattgggcacaggtgcaactaataataaagtgggtggtactttgttgccatttccatgttagggcctttgtgtctgcacttctctctctctctctctctctctctctctctctctctctctctcatgctctgcatctttaaatcactaaggtctcagctctaatgttatctcttcagagaggccttccctgactatccagtctaaagcagactcctcattcccaccaactcactccattacattaatcttttattttgttaatagctctcattgcatcccattactttcttctttatttgcttgttgcccatccctacctccttcccaaacacacttattaaaacaccatgaagacaaaaaggtattgtgctcaccacttgtttatccagagccaggtgcctgtccaaagtagatgcacacctgccatgtcctatggccaaccaggtccaatgaattcctttataaagctcctctcctcagctgacccagaacaccagctgctatactgaaggctttcacactttcagatgaggtgtctttatcttataaatttcttttctctaagcagaatttatataacctactcattactttgaatagcatcttattcagtataccttattggtatttttcagtaaaccctggtataaggcacacagctaagtgaatgtccccacatacctataagagagtggctagatgcctttcttacccacagggatggtttcaaagaaaccttttacactcactcccatatacacacatacacaaaggaaagctcacatttgcattccagatcatctccaggaggagggaggagaaatactcttttaaaagagcaaacctaaaattataatgctcttgaaaacattagtagttaacatttactgttaagaaagccacaatcccagaccaaagatagctgagtggcatcttaaattgaagatagtttttaagtcagagcttagaaagtctcttggaaatctctttaattcccccacagaataaaatatggtacagattctcaggaggtccaatagaggctttcctctagcattagaacagatccttctttgatcaaggatcagatgaagtcattggtgtgaatttactaggcatatattttttcatatataacagaaaatgtcaacactggaatctcactcagcactaagatgctcacactaagaggttcaggaaaatgagaatgactcccagaacccatctcacattttctaagaggcatatattcattgaggggaacgtctaacagaatgacctatattatttacatcagtacttcctactctcacttttttggccaattctgtgtgattaaattggcaaaagttcaatgcacacaaggtgcaactcaattatatttaagatcactcatttatgtcataaagtctttctcaaaaaacaaaagatgccagccccacagaactttatcatgtcacatagaccccattaatgcagtctatcaacaatatagacagattattatattcagggaagttccctcaagaattgccttacaagttcaatttaaaaaatcaaaataaaacaagccagtactgagtctttctatggtatagttaaacttgtaatattttatacatattttttgaaagtagccttgatataaatcctgaaaaaagaaaaaaagcaaagtccacatttctataagtgtcacgatgataaattttatgtatcaacttgactgggccatgaggtgcccagatatttggtcgaactttattccgagtatggctgtgagggtgctttggacacacttttaatatttaaatcaacagatgcagtaaagcaattgccctccctaatgtgtgtggacttcatccaatcagctgaaggcttgattaggacaaaaaaaagctgaccctcatgcaagaaagaggaaactcctcttacctgatagtcttcagctgggacactgattgtgtcctgcctttggactctaactgaaacactggctcttcctgggtctcaagcctgttgatcattggacagaaactacaccattgggtctcctgggtccctagcttgccaatgccagatctggggacttgccagcctccatagtcacaagagccaacttctcataataaatctctttctatacatatggatacacacatcctactgattctgtttctctggagaaccctgactaatacaaatattaaacccaaataaaaacccaaatgcaagtattaaacccaaacccaaatccaaagatgaacaactttcttcatcagtctggcacctaactgcatgtctctttatgaagtatgtaatattttttcatgagctgccatatgtcattccatcactcgctctagaactcttttaggcacttaaaactttgtatattatattaaaatttaatgtatcaagaaaggatatagtgagaataaactgaaaagagtagttactaatgccaaatataaggcagtcttgaaaaaaagaaatattcctctgtaatctcagtactttgggaggccaaagtgggaaggctgcttgaaaccaggagtttgagacaagcctaagcagcatagtgagaccctatcccctaaaaatcaagattttttcaaaaaaagaaatattccattttttcagtaaaaatattaaacaaatttcaaaaggcagaatggacagcttatacatataaacatatagggatatgaaacacatagttaaatatctacctatactttttatttcattaatttaattggatacttaaaaacatgtactttactcaaattcttatgtgagcatctcaacacatggtttattcaaattctgatgtgagcatctccaccatataagagcctcctttttagccctccaactgagttttccagagttttccacaaaactccaactgagttttcttcccttggttcaaaacaggacactccttgaatcatgtatgatggtgtttctgaaagttgtctctgaaggcacaagtacctatttatataatattagcagctttttcttctaaataaaaatatttctttgaacaggtatatattttgatgtctatgatgtatttgtctcttgtattgctttttaaatagacttttcaaaatcgctgtttggaacaacatccaacagttggaattgtgaagtcatagcccctggaatcatgactaactgtgttcaatttccctgctcctcttttatggatcctagcagatgaccttcacgagcacccaaaacaaaccttgggtgaagccacttcagcccactgtgacttcctaaagcagtatttgaaaggacccaaatataaagcaaggtcgtctcttctgagggataataaattcagggggaagcaaacctcacctttgtatttgaggatatctggtgtattttagtgcaattctgcctttaagataaagtgccagctgacttaatggcagttgtgatctctgcttcatttcatcttttatctaatgatccgctagttagtaaacctgcaaatcctgaaagaaacataagtactctttttctttgcagtgtaatcaccaacaataaagctttatttttttgcattaacattcaactgcaatgtatttaaatgttccacatacacaaaaacacctgatttttcccaagatttgttaaacatagtccctttggtgtccttagtaacactgcaaagatgtcttcatgtaaaacttaatttgagtcctgattaccttactgtgaaaaaccgtaaacaccaaacaaaagtaagcataatatccaaatgcctaaaacataatacccaggttgaaggaagtgtaaatgttcagattcaccagtgggactagaatgtaaacttcttgggttgtggttcctccaaatcatctggccacctgggtatcatatcccacaagcatatggtaacactgatagagtaagctcaaagtgttccaacaccaggacatttcatggccacatcagaccaattgtatttttcacttcctctctttccctaacttttctcatacaaagcttcctacatttcctttggcacttagtaatacttaaatgcatcttcactgtcttattcagtgtttttagctttggaaggtgtatcacttgggattgctttcagatgcattaattgcaatctagctaaccaacagcccaacagtgatttaaacacagaaagctttcttttccggatatgcatgtgtgcatattttgttttgtttttcatgcaacaagatgtctgaaggtataatctgacactgagctggtatctcatggtgtcatgaatgccccagcctacttctattttttttttttttttcctctgctgtccttcagtgaggctttcactttcattgtcatagacggctgctggatctccaagtttgacacattctccctaggcaagaagagggggaaaggcaaaggggaaagaggatgccagccaagtcagtctctttctaaaagctttccagaaagttccatccagtgacttccacatacatctgcccagccacaaatgggtcatacagtctttcctaactgtaagagagtgtgggaagctggatatgagctgagcattgctgctccaaacaaaatcagatttctgttaggaaagaatggatgtaaagtggatcttaggaagggaacaaccaatgcctaccatacacaagtatttgtggtgagcagacatggctaagtgcctcttcctatctagggaggttcagggaattactcaagatctcttttgtgccagggaactagggagtcagtcatctcatttgctttcatttcctcatctctgaaatttcctactatggtattcctcttagaacaccatttagaagtgttatggttttctgttcttaatccaaatgtgacaaaatgtattctccttcttctctgataacaaaacccaaattctgacgggcagcatgtgcttagccttagataatgaataatgactggtctaacccaatcatggcgatactatgttcttttgccattgattggtattcagtagtaggcatgtgacctagatctaaccaatgagtggacatacactggggggactcatgaaagatttttcacctttggtaaaaagtcatagttgcaagaggagaaagccttttcttcatatgcctcttctttcctgttttagatgctgtcatgttaacgctttgtgcttagagctgtagaagccgtcttgtgaccatgaggcaatagccaaaagaggaaagagcctgagtatgaaagacactgggtcctttatgatattactgagttgccaaactaaccctgggatcctctacctcctgttttctcatagtaataaatatccctgtgatttcagcactatcactttaattttctgttacaggcagctgaaagcattcagaactcacatactatcttaacatcatcttccatgtgttatgggccaagagtatattcaagagtgactacaaaactacattcattgtcgtatccctgtgggactcccttaaagttctagtgttctgtagtgtactttccacagcctagaaggatatatgtttccctctctccagccctaaggaactcttaatttaagactgacaagatgaatgagttacaatgagggtgaatccaattcaaaagacgtaacaacaagcaagaaaagcaaagaaccttgtaaacacccatgttatggagtgtgagagtgtaagcttaaggaggcttttattttggggagaagatgcatcacctctgtttgaatgagagaaattaagttgtaattatgatggtgtttcagttaaattatttgatgtggaagacaaggagaccattcccaacatgttatttagcaaagaatatggaggagaggcagaagactgtgatggaaaacgttcagaggccatcaaccaaaatggtaatgcattcgaggcagataaagttgcttcttgctagacagaggtggggtgagccctgacatacgtcttcaaaattgcaaaaggcacagatctgggggggaaagggggttgattcaccaaatctcagaatagcagaatggcaataaccctactccaaggcttccagttttcctcagtttaactccttttgcatactgcagccaaagagattttttttaaaatgaagatcactcagactgtgtcctcttcctcttaatctccccaaaggaagaaaaaaacaatgatcaatggcaaatggcagttgcaatgaagcaacaccaagaacgagcttcgtgctcgggagagaacattgcatatcttcctgtggtttccagtgctctacacacttggggaaactcctttaagtaatgaaccacagaaatgacccctggaaatataatcttcaaagtgatcttttaaagatccaaatatttcctgttcccactctgcccagagatcttcagtggctcactactgcttccatgataagatcctaaaaccttgtcacaatccacaaggccttcattgtccatccctgcctgcctcactgtctttatctcccaccacactctgccttctctatgctcccacctgacaacttcttcagtgcgtggaccctattgtactctctcaggcctcaaaaccatgtaacatcctggacttcctcttcactggtctaatgcctactcatacttggcttctgagattgtacttcactccacatggagattatccacaaccatgccccactccaaaaccaggttaccttcccaatgtgatatacttgccatagcactcagcttccttttttataatactcatcacacttgtgattgattgactctcttctcctttacattgtaagatccataaaggcaaggatcatgtctgtctctttctgatgtgtaacaagcctgaacatacatacaataaatggccaggtgtaatttaccattgtgtggatgccatcttgggaggggggattctaatagttcaagggcatgtatgaaaaacagactcatggtaaaataataagaatagaaaaaagttactcagagtggtttaatggctggggtataccttttactattttacttagacatcaaaggaaaatcagtgtcctccctatcatgttccatgattttgtacaactgagtttagagcacaagctaaggtatcagacagcatttgacagcccagcttcactacttatcagctgtgtgaggtgatataatccctctaatccctataaaccttagtttcctcatctttaaaatggggataatgacaaaagcttttcaataagggtttgtgaggattaaattagataatacatggaaagctttcatcccagtgcttgccacagagttagcatgcaataaatgttataaagagttctttattgttctgcccatcaacatctgagacagaatataaacacaactgctcctgggcctggtggctcatgcctgtaatcccaactttgggatgccaaagtgggaggatcacttcaggccaggagttcaagaccagcctgggcaacaaagcaagactccatctctacaaaaaatgaaaaaataggtggatatggtgatgtatgcctgtagttctagttacttgggaggctgaggcaggaggatcaactgagcccaggagttcaaggctgcagtgagccataatcatgcctctacactccagcctgggctttttaagattccatctcttaaaaggaaaaataaatcaactggatcactagcctataagagcttaacaattgttaggtagtattactatgggtgttattgttttgttatttgtggcaaaaagtactagtgctcacctgagcacatgacttccttatgatcaggtaggtccatgtttgtcttggtcactactccagcccagtgcctagcacagtgcttgacacatggtgtgtatgcaatgaacacttaatgagtacttaaagatctaaccagtatgatagtgcagattctcttgtaagcaaatgaatagagaaaggcagtattccacagagaaggagacaggaaaaaagaacaggcttgattttactaaaaagaaaaacacacttttaagcagtaaaattagaagttcccatttcaatggcacaaaatagagaactcactgagaattgtgtgctataacatggtcaaagcagaggccgataatgaagggagcagcattcagaaccatcacatgtatggtcagctttcagaccctgaaaactcgattaaaacattccaggaaaccgctgcactttcattctaaaggaagattgtgaactctgttcacatattacaccccttcatattgctttgtctaccagtgtggccttttatgaagtgagggcttctttcttctaccttgctccatgacaatcaaacccaaaatgccttccacccttaaaaggaagttttggtaagtgccttattataactatcacatatgacacaaggctcaccactaatcggagacagatgagaatgaattacttaaataggacagaaatagccattcacttcaagaaggtcccagtttcttgaaagtctgtggcattgagaccatttacagtttgctgtcaagattcctagcagtgctcattaccttggctagcaatccctctggactacagaaaacttatctgaaatatatataatcacaggctgcaatgcctaagtgcaacaggatgatttaaaaagcaccatgatagtgttcccccaggacattcatctctccctgtctattcatctttgatccagacaaaaacttggaatgcaatctgtatattgatattccctaaaaaggatttcaccagctctttaggaagaattgttttagcggctctggaagtctagaacattctgcatttgtggtatttacagcttttgtttctatttcataaaaataaagccccactaagagcagtattcaattcctatcccaataggagtatcgaatagtggttaagcacatgttttttggaacgaagcagacctgtgttcatctctgggctcctcatagacctcttcataaacttaggcaaggtattcaacctttttgagtctcagctatatcaggtaaattactatgcgtgcacagaagagcttaataaatgttagatgttaatggtattaatattgttttgctgctgttttcagtttttctagcagagattattagtattcacccatgtgcacaggtagaccgcatttccacccatgcacacaggtagaccgcatttccaagcttcagtggagttacgtgggtccaaatgactgagttccgatcaatggaatgtggcagaagtgatgtacaccctttcctggatgggcctacagaaatcctctagactctactcctcactctccttttcccttctcaggcaccctgaaggctacttgttaaagaatttagagctacaggatggaaagaacctggatcctacctaagaacctcctaggagagccacccttcagaaacatttgcagtggattctgaatacgatttttttttttttttttttttttttttttttttttttttgccgagcacggtggctcatgcctgtaatcccagccctttgggaagctgaggtgggtggatcacttgaggtcaggagctcaagaccagcctggccaacatggtgaaaccctgtctctactaaaactacaaaaattagccaggtgtggtggcacgtgcctgtaatcccagctactggggagactgaggtaggagaattgcttgaacctgggaggcggaggttccagtgagccgagattgtgccattgcactccagcctggtgaagaagtgggactacatctcaaaaaaacaaaaagatacatatatatgatatatctgatatatgatatatatatgatatatctgatatatgatatataaatgatatatctgatatatatacatatggtatatatgatatacatcatatgtatatatggtatacatgagatacatcatatgtatatatggtatacatgagatacatcatatgtatatatggtatacatgagatacatcatatgtatacatgagatacatcatatgtatacatgagatacatcatatgtatacatgagatacatcatatgtatacatgagatacatcatatgtatacatgacatacatcatatgtatacatgacatacatcatatgtatatatgacatacatcatatgtatatatgatacatatatatcatgtatatatgatacatatgtacatatatatgtatatatgatacatatgtatcatatatatcaggtatatatgatacatatgtatcatatatatcaggtatatatgatacatatgtatcatatatcaggtatatatgatacatatgtatcatatatcaggtatatatgatacatatgtacatatatatcaggtatatatgatacatatgtacatatatcaggtatatatgtacatatgtacatatatatcaggtatatatgtacatatgtacatatatatcaggtatatatgtacatatgttcatatatatcaggtatatatgatacatatgtatcatatatcaggtatatatgatacatatgtacatatatatcaggtatatatgatacatatgtacatatatcaggtatatatgaacatatgtacatatatatcatgtatatatgaacatatatacgtatatatcatgtatatatgatacatatatacgtatatatcatgtatatatgatacatatatacgtatatatcatgtatatatgatacatatatacgtatatatccatatatatgatacatatatacgtatatcatgtatatatgacgtacgtcatatatatcatgtgtatatatgatgtacgtcatatatatcagatatcatatatacacatatatcctatatgtgtatatatgatatatgtatatatgatctatatacatatatatcatatgttctatgatatatatgatatatatcatatatgatatatatgatatatatgatatatatgatatatcatatcatatatgatacatatgatatatcatatcatatatctttcttttttttttcagttaagctactgggttttgacgaagctcattacagcagttagcctacttcagggtttctcagcctgggcactactgatattttggactacagaattctttgttatggagggctgtcctatgcattgtagggtgttgagcagcatccctggcctctatcctgctagatgccagtagtaacctctccagtagccatgacaaccaaaaatgtctcctgacattgccaaatgtcacctgcaaaatcgcctccgattgagaaccagcagcccacactggccaaaacatcaccatcattgctatcatcatcatcataggatattgatagtctagtctctcatgttccccttgaaatcactgcaaaaggactcaaagttccaaaagaggtccagcccagtttttttaggagaaaaaagtgaaatgacactaaaatttaagaaaaggtaagggatcaagcagtaaactcaaagttataggagaccaaaaaacaaagtaagaaccaaaataaatataatccttttttaaaaaagctagtttgtgtagtcccagctactagggaggctgaggcaggagaatggcgtgaacccgtgaggtggagcttgcagtgagctgagatcgcgccactgcactgggcaacagaccaagactcggtctcaaaaaaaaaaaaaaaaaggccggtttgatcactttggtaacctagaataaaatgattaaaacaaaaacaaacccaaatatctgggtctaggaatttcaatgtgtctaacaaatgcttatagaatatctaccatgagataagcattgggctgaatataacttggtaaataaaacagatataatccctgccctcatagagatgaaaggtaaataaaaatatggagttttttgtttttgtttttgtttttgttttttaagacagtgtcttgttctattgcccaggctggagtgcggcagtgagatcatagttcactgcagccttgaactcctgggctcaagtgatcatccgtactagctaggactataggtttgcaccaccatgcccagctaatttttgtattttttttatagagacgcggtctcactttgttgcccaggctggtctcaaactcctggcctcaaggaattctcttgcctaggcctcccaaagtgcttgggattacagtcatgggccattgcacccagccaaaatatgatggatttttcaaacagcttaaacacagtcatgaattgaccactgcaataggcagacttctaaagatgtccctgcaggattcccatccctgggccgggcatggtggctcacgcctgtaataccagcactttgggaggctgaggcaggtgggtcacttgaggtcagaagttgaagaccagcctggccaatatggtgaaaccccctgtctctactaaaaatacaaaacttagccaggcatggtggtgagtgcctgtaatcccagctacttgggaggctaaggcagcagaattgcttgaacccgggaggcagaggttgcagtgagccaagactgcaccattgcactccagcttgggcgacagagtgaaactccctctcaaaaaaaaaaaaaaaaagattcctgtccctggttatccaattaaacactagattaggtgctgccatgaagagacttagcagatgtatcaaggttactagtcaaccgactttaacataggaaggttatcttgaattatctgggtatgcctaccctagtcacatgaggttgtaaaaacataagtggaaggtggaagaatcagtcagagtgagaaagcagaagaggatgcaggagctatgctgcagagggaaagtcagattccaaacacaagaaagaaaaagataagatgaatcattgatggttctaaaatgtaggaggctctgtgtgaggaccagaaagaggcctgagggagctaagggtggagccctgcctaacagacataaagaaaatagggacttcagtcctacaaccacaaagaaccaaattctgtcaataacctgaacgagtttggaagttggtttttctgcagtctccagtaagaaacacagcgctgctgatacctcgattttagcccagtgagacatgtattgggcttctgactgccagataataaatgtgtgttgttttaagtcactaaattcatcatagtttgttatgacagtaatagaagactaataaaccattatgcattaaatatcacagaaaagaaagggtttaagaaaataggtattaaagtatgccttatcaccttatcattcatcaatctgaggtttactaaacacttgatgggtgctcattagtggaataaattaatgcactcatattttcattcatttgttaaaaatatgcatacagtgcctcctctttgatggtccctgggtgaggtattgaggttacagtagtgaaataggtattatcctctgtttataacagctcataatggaagtggaggacagaaacatgtacattcaacaataatgcaaagaacataataaagatattaacatcatcattataaaactatcagtaaaagtgtgaataagggagtacagaataataattacagctgacatctattgagtacttgtctcatttcccttcacaacaagcctatgagactgtattagtccattttcatactgctatgaagaaatacccgagatgggataatttataaagaaaaagaagtttaatggactcacagttccacatggctgagaagacctcataatcatggcagaaggtgaaggaggagcaaaggtacatctcatatggtggcaggcaagagagcatgtgaagaagaattgccctttataaaaccatcagatctcatgagacttaatcacgagaacagcatgggaaaaacctgcccccatgattcaattacctcctacccactgggtccctcccatgacatgtggggattatggtaggtacaattcaagatgagatttgggtggggacacagccaaaccatagcagagacagacccatgattcataccatcttgcagattaagaagctgaggtacaggcaggtgaagaaaccagcctaaagttactatcggtaagtggtggagctggaattttaacacaggaggtccaactttagagcccatggttttaaacacttcattgtgctgtctctcattgcagaagggtgaggaggcctcacagaagggctgagatttgggatgaataccttcatcaagaaaaggaggagccagtagaagaaactgcattggtaaagccagagattcaggaagaaggtggatggtgtggcatattctggaacagggctctgtattggcaaggaggggtggcagatgaggttggagcctaagttgtcctgacttgaaagacttgaacctctcagcagtttgaatttcgttctaaagctatcaaaagaacctattcaagagcatgatacggtaaatcatcttcagcaactcacatatcatttttaacattgtttcaggggatattagtggacactcttaggaacgcagtgtatagcccacaagtataatgacacttattaatacaacttagaaaacaccctttgaaaatgcatcaaaaccctaaaagattcgattaactctatggaaatgaggataaagggtagatgcatgtaagaatccagctgtcttctatctacaaagctcttcatatccacaaccacagagacactgctcagcttctgaatcgccttagttcacaataaaatagaaataaatcataataaaataaaatagggaataaatctatctgttggctttgagaaaatttctcagtagcaacaaaccaactgctcaaatcagaatcccccaaaataaataaataaggtacctaagagggaatgcatgtgttgaccaaaaaactaaaaaattctcccatttctgtctgacgttgaaaaaaatcataggtatttggcattttagcctatgctgttgaatgtggtagccactaattatatgtggctatttaaatttaaataaggtaaaattaaataaaatttattttctcagtcccattagccccatttcaagtcctcaacagccatatgaggccactggccactgtactggtcagcacatgtatcagacatgtccattgttgcaggaatatctgttgggaaaaaaatgaactacttatttagataaaagtagtgatttgttagacatgcctaataaaattcagtttattttaagattatgtaattaaattcagacttacttataagagtctgaattttcattttaatcgtttgtatgtatttcattcctcttagtatgaagagagtctatatcaagagactctctatggagacaggagccagtttgtattaggccccagctctgtcttgggctctgtgctaggcatttcatatctgttatgctacttaaggctcatgactccctgtgagataggcatgcttattctcatttttccctaaatggggggctgtgacaaggctgaagcaaagagagggcacaacatcttttcagggttaacacttgagaaacatctatttcttcttaagtagctctactgctgcttagagaagtagagtatgtagacaagacagttaaattttccacagatggggtttacttagagggagataagatttcttttgcacacaattgtagatttttttttaaatggtcaaaatcctcctgttctagcagtagctaagaagtgactcggggaagcattcaacaagtaggaaagaagtctgctcagatggaggccctgaatcagagatgcctgtcatctgttcccaaaggctccaaactcctgccacaaatacactgagggttcctctctctataacttcttctctttattttctctggaaggaatgtacttgatacttatttttaatctgagtctccttccacaaaaagtgtagaggatgtgctacccagcccctaaagttttgcctcttggtattcacacttgtgaagtcattttccatgtggaagagggctgacctgtgtaagcaataagatgctgcagaaatgtatgacttctgtggctaggttagaagagccatgagtccttaaagctttcccccttttctctctcttgagtggctgtctctggaggaagccagtcaccattctatgaagttactcaagcagccagtggagaggcccacatggggaggaactgaggcctcccaccaatactctccatcaagctgccaggcatgtggtaccttagaagtggatcttacagccccagtcaagccttcagatgactatagagccagaaccactctactaagcctgtcccaaattcctaactcaccaaaataacatgagatagtaaatgtttactgcagttttaagcagttgagttttggcataatttgttatgcagcaataggtacctaacccagagggtttttccagctttgcctatgggcaagtctacagatgaaacaagctgcttttcatatttagtgctctctctcacaattatcaggagatataattatcttaccatccaggctgtgattcttgcacacaagcaccaagtcatccattattgcagtctcccttcccatgcttgatgaataactgggttcctgtgatttttcctcttttctttccccattgactgttgaaattgtttgcctcaactattgagtcccttctcttcagtttgcctccttttcttttcctcctacatgagcagaagccaggaaattgaatgtattcgatcacaaagtatgcatgaccctcagcaacatgagcctacaatagtctttttaatgaccagaggaaggttgtgaggactcttagttaatttgttatgaacacccactcccataaggaagctgctatgtatttgtggaataaattaaataaaatcagcaaatttgcttattatctatttcctgccctttgaacacaggtttacccataaactacatttgttacacactaactgaatatggaaagcactatgggtaatgcaaaaaatatagcttgtctgttttcagtgtactcataagcaaatataggagacatcacaaagatgcaaatatgtattcatattcacatacatgcttaagtagacatttacatatcaaagacagtgaaggctaagggccaaatgaatggtacacacaagtgttaacagatcttcaaaagaagatgttatggctgtgagctgaattgatcagggcagcctttatgcaggaacaaagtcttcagaaggtttaactatggcagatactattacagatactacttgtttcatccagttctcctttagccccaagcatagagactcctgcacatctcagcctcttatgagtgggcaggatcatgtgactagctctacttagtggggcacgagaaaaagtaacatgtttcatttcttaagtcaaagaaaaaactatgtttaattctccaatctttctcccccaaaagttcacatgctctggggtaactagaggatgttagtggctccctcagcctgggtctatctgaatgactacaataagcagagccccctgacaactttttttgggcatgtaccattagcaagaactaaacctttctttgtgataggccactgtgatctggggactcatttgttactgcagcataacttagtctctcctaactaaaacagagattcccaaagatggagaaaagcagagcacagtagaggtagcttataagtcatgtcttatatgacctttctcaatgacaaacctgtgtgctcaccaagacatagcttgttatgacatatctgaatagaattgaaggtttttaaataaaaacataagaaggttggaaaggcagcagaatgagctactgcctgtgggtgatctttacacatctcagaataacaggattattgatgccttggccagaagcattcctttccctctgttttctttttctttgagattgcaagccatatatttccatttggaaaacagtatttcataacctctaaacctaacatgagtcctgtgaaaccctagtctacagttgaatggccaaaaataaagacttgaaattccttcaaagctatcccattttacaaggcaatgctttctctctctaccaagaaagtgttcctgcttgatagattcccctctcttgctgtatattacacttactgctctcctgtcactccctattctcttcctagttgtttgtgccttattaaattccacattttgaaacaaccaataagaatcagaaagcctgaagaagccctttctcatacaatcagagctccctttttatctaggaataaattatattttccaatcaattcatgagtgggattcattgacaatatactctctttgtaacatatttctgaatgagtagtaaatggtcttcaataaggatatggcgatacattttagctaaactgtttcataccgacattaactcccctgttaacttacttaggagtctaaagacacaatcaaatagctgtttctgactattattctcaaagcgaagctccaggccgtaatctcaggacatgcatgaaaatatcaagtaacaactcaaaggcccatttcagcttcaaatacctttgaaaattcgtgagtttgaggagcagagtgggatagcaggcgagtggaagaggaggcttctgagaaacttaattatctacattttagaatgtttcagtctttggccttttaatactgtagtatagcctggcttctgtcattctgaagggatttcccagcttaacaaaatcccaaggaaccaacctcagattggtctcttacctaaggaaagattctggcaacacaacaggaaggatttggaaaatttaatgaagattttgaaatacccctaacacacttaaattaaagataatacctatttcacccaaatctcctaaccccctgtggaagatcaattctaatttttgaggacaattattcatgtgttattggcttgaagtacagaatgtattagtaagtctcttcagttctaagtaacagaaaccaaatcaggctaggttaaaattgaaggggcatcattagaaggacccaagagtgtctcaaggactcagaggcaaagatgcagccagttccccccagtgccgggaaccagaaggtgggcaggaactcagggaatacagcccccttctatctctgcttctcaattctcatagggaaatatggttgtccacagatctcaggtttacctgtcatagttctagccacatgcaaggaatgactgcatatctctgaattccaaatttcagaaagtgagaccttggggtgggagatggggcacgcttggattcggtgtctaactctaattcaaacaacttttgccacggagccatgtagtagccaaatatgtttctaaggcccaagggaccactcttacaaagatggaagatagttcactaaaaagaagacatgctttctagactccacagccaccccagaagtgccaagataaataatagggagccagagtttaagcaagggccaccatcactgcaagttgtctcatccaacttctccctttataggaattgacatgacttcaaatattcatgtctgacaccaacgaagaggaatgtctgttcttgagctctttttctcggttcccaaggggccctcagtaccctgctttaccatttagtgtggattctgacaaaagaacaaattaagtactttgatttgattcttaatttttccttataaagacttgcaataaatattgtgggtacctagaaataatccaccatagtgcacaacacaatctgttgacttaccttagcttccattttccttcttggtctgacatataaattcaccttgctgctcaattctgtcacctactattttcagcatgtatgagcaacagtaaagtgcatgcccacagaactcagaaatgagaaaactaatattgctctgttatatgcataatggatcaatacagaggtatttaaacacacaaagaaaaaaaaaaacaggtcagcaagacttgactttcaactgatagagaatattaacatgtttatgggtagaaaaagtggtcagttgtagaaaaatatacaaagaaaagctacaaagagatgttggcagtggccatttaagctctgtctagggaaaggaagcctttagttaatggccttcaagtattctaatgtagggacacggcacccctactgtggaaagagatgcaggaggtggaaggtagctaaggccttggagtttcagttccacaggcaaggctatccttatcatgagaactgagcagcatgaagctatctgtagtctgacagtcatattgtatgttgtgtcaaatgaaaacatagcatcactcaattccttttgttctcttctcttgctaaacacacaactatctgatgctctggcttcccatggacctcaggcctgcttagaggatggaatgcaatagtcccactagtctgtgcagtgggccaactgctggttgtaaaatcacaaaggggccttctaggttaccgcgtctcacaaacttgggtaatgtaattccgtcttgaagagagagtcccccatgggtaagaccatggaccatggtaaatgagtgtaccccaggagaactgcttgggaaatagtcacttagcctattctcctggtgatgccccagacattgtcaacatggaccccttggagcatttcctcgttgatgtctacatttgttaccttactcttaattaaattttctaaaaagatggcacaataggagcactgagaacatgatttttaggaagaaaaggaatcccatgtaaacccgtttccatctgtggttcttgcctttctgtccttatccatagggcagctcattcttgcatatctgcagctcttgcatgcctgccattttgtatcttcctttttctcgttatatcagaagcattataataagttacattagaacccgttttgcatattttaacattgccttcacagtgaaactatagagagctttatggtggcactctagtgaatattctgttctgcttctgttacatgactaccttaggaaaagtctccgagaactcctgtctcccatgattatctctcctaatcaggctttctactatcaaactactcagcaaaaggaactcaccaacctatagtgctaccagaagtctaataacataacactgtcaccacaactttttcagcactaaacatgatcatttttaaaaatagtaagtttattaggtatataatgatactttccaagttccagcctgtttataaaggactctgtataaataaggaaggggcccaggaatggtgacatatttaacgtgtaagtcaggatgctaaatgtctgactgtatttgtttatttttttctgaaatggagtcttgctctgtcacttaagctagagtgcaatggcacaatcatggctcaatgtagccttgacctcccatgctcaagtgatcctcccacctcagcctcctgagtagctagaactataggcacacaccaccatacccagattttttattttttgaatgtatttatttatttatttatttattttttgtagagacgaggtcttgctttgttgcccaggttggtcttgaacttctggactcaaatgatcctcctgcctcagtctcccaaaggattgaaattacaagtgtgagccactgtgcccagctcctattatatttttaaaaggaatatactgaggaaaatacaaatggagttcaactgataaaaagaaacctctgtaatatgagcaggtgaatacaatttacaagatcatacttcagtatgaattcagtaggaattgcatgttttgcctgctgtgtgtccctaagggtgacacactcctgaatgggactttagtttgccataagcctgctttgttttgtttgtggtagaaattccatgctatgaggaaatgctttcatttcttttgatatctcatgagcgcttgttgcaaaaaacatttgtaggcaaacagcttcacacatattaaaaacttgtagcagaaagttaattccctaacataagttgtccagctcagggctctataatcctgtaattcattttggttccaataaatacgtactttctgtgagaccctttggggaaagggtaattagatatttcacatcagtgggatatctttccttcttttgctccccctccttctttccttctccttttcttctctttaattcttctacccagaaaaattctcaaggagcaaaaatacattactctctgcatttttataagctggccagttttgcttcctggcttttgaacagaaaattatgcctcaaaaataatcccacattattctctaaattcattttcctcagtcattagcccataacggcaattttccttttgaaaataaagaataatgatcatttattgagacaaatcctcaatcagaatgattcaaagagaatacaaatttaatgatcaccctgagaacccaagtaatacatctcaggaaataataataaaatttatgatggccttaaaattgcttaactcctttcaggaaaccctgaattatagggtagtaacataaccaaggactggcaacaactcacaaaagtctagaagagttttgcctttgagttcatagacaaagatgcttaaattgttccccgttcaaaaaataaagattatttattatttactttcctgtgcaccggacactcctgcaacatgactataactcttgcgttcttagatttgatcttcaaggtctctgaatgatgaaaaaacttgtagggtagcatgccaaccaacttgggttttttgtctgtttttgtttttggaggaggggaacaaggcagggagagagggagagggagagagagagagagagagagagtgagagatcacactaccaggagcttcataaagaaacctgcaatgcagaaccaaagtggatgaaagcaaaaggatacaacttttccctccagatgattttactgggaggaagaaagatttgaaactattgagtgctttttctgataaccacctatggctctctccaaagacacacatgtaaagttgggcaagttgttttctgtcatgtcaggaaaatatttagtagcagtcttacaaaagtaagcactcagcgccgtcccagggagctgtggatttgctgtgcagccttgtttccttcaacaggttcctttgttgctttgtgtgttctcccgacaaagggcctgcccttcttctacagatgggtttaccattctctctgaatgaagactattcagaagtacacaaaccaacaaaccatccaagctgcctctatctgatggtcctggtatatccagagtactaaatagtggcctacaggatgggaaattcacactgactgactccacaggagactgagaaagcttaactggctgatagctgtaaagtcctttgaaggaacaagcactgtttaaaattctaagtagtaatcttataatttgctaatggaaagaaatataacccagctaatgtgtgcctcccatttcagagagtatgtttcaacagcaaagccctttacaatatttagataaacttcgatgtatagaaagtgcaacagcaaggtaaacagcagggcttcccgctatggcattttaaaatgtggtgggtgaaatttgtcactcctaagcaagtgcctatagtaaaaataaaatatcactatttatatggtatgtgttaaaaattgtccactctccccaactacaccagatcaaaacctcttgttttttaaattatgaaattattgaactgtattgagcacacccctacttatgagttgtgtaacctggggcatgatattgaacccctctgagtcatttcctcatctatctagacaaggctaatggtaatacctacattgtagggctgtcgttagaattttaaaataatttaataaaataaaggctagtatttattaaactctaaatacatgtttgctgctatcagcagcagcagcatcggtcggcaatcacgccaacactcctcaaagaaaacagttctgaaaaggctgtgtgcatcctaggtctgaagattttcttggtctaaagagtctcttgggctagtgaccaaatccttcattaatttcaagagctctgggaactctctgaaactgaatgtggaatggtataactactggtctgtgcacatttttctagaaaacctcacatctttcatcacattaagaggttaagaatcattgccatatgtagtcattagcttacctttatctactttctacttctaacggagaactagagtcctgtttagaacaagtaaccaggacagggacagaagaaggagactatgcatctgtcactcttgctgattagtctccaccctctcccagcttctgcgggcctcctctcccaagagttgcgatcctagacccacctcccatctgcagtctcaacctatcctcttctaaggactaatcatggcatatggcaggagagatttaagactagctaggtcaatgctctaagctcaacatcaagtcacctctgaggcagggtgttgtcatggaatgatcatgacctctgaaataggaaggtctgtgtttgatttggcttgaccacttactggacgtgtgaccttggaaacgtttacttaatcatgtcttttgtcacctataaaataaatacaataagatttacattgtgagtctatgagagagaaatgagataatatagagaatatttttaaaatgggagcatatgtcaggcaacagtagatgctcagcaatgttcttttcttacctgggcttcaacctggcacccttggtcaccttcccaggacccaaatccctctaggaataaactctggcccttgctggcttctttattcttcctcccacctacatacttgaacccatccaaagaaataggtctgactaccttggaaaccttttctgatgcttactacttgtccaacattcatttttctgtaccatgtgtgtagatactggattccccatcctagaattctacccacctcttgggctaccctgttacaatgtgtgactgactatcctactcccactttccaagttaaccacttaattgaatggctgcccatcaacatactccttaaatgccaagttagttctgtcaaacccaatccacagacaagccttatcctcaaaccttttctgccctctgccacagtgctaactggttcattgtgcttgttcagcatgcagggacctttaatttaatgggcctctcccatttttcacatatcatgaaagttatcaaatttaggttaattaagtttaagacatccatagttattcgagtgaaaacttgaaggcagcataatggataataatggtaaaatgataatttttgagctcttagtagatgccaggcatagtcctaagcagtttaaatatatttttttcatatgattttcataacaatcctacatagtagattatgatcattatctctactttataggtgaggaaactgagacttagagaagttaagcaaatggccaaaagttatgcaggtagtaagtagcagacatagaattgagaagacagcccccattctaaataagtatgaaaaatttcagggtgtcaatttttagctaaggaaaacttattcatgtgtgtgtgtgtgtgtgtgtgtgtgtgtgtgtgtgtgtgtaaatgaatagatattcatttacttatatatctatttcccaggcctcaatgcaatcagagatctctgaagaagtgaccatattatgaacataaatttttgacttcataactttacagtgataaataacctcaggttatcaggatcctaaccttaaaccacctgagattttatcactgttcctttagtaagcaagggatttttcaaccctgagacagataaaaaatagattgtatggtcaatgaaatccattatattcatactttttggttgagtttaggtaatggaacaatctgagaattttgtatcaagtatttgtgatgtttaagaggatttatcatatttaagaatctgacagattgcccctgcaattagaagtacaattgattactgacttctaattttaggttaaaaagtttaacagaatttgatgtttttaagtagtactgagatgtttaaataactgaatttattctttatgagtctagtatatttgattcaaaacatggcttcaaagcttagaaaggttttgcttgttaaggttgtgagcttgtactgccaagtattcgaagtgtttacaaagaaagtaaaattgttaaatgtgtaaagttattttaaaatattgatgaatacatttaacaagtaaatacaaaagtgtatttaagtagacattattcttttatggcattcataaattcataaattgcacaagataacctgagttgctctaaatgcttttcaaacttaagtttaggggagcaacatcagcaagatggctcactagaaactccagcactcatcccttccacagtgacagccaaaacaatgaataaacaactacactttaatgtacataactgaaggagagtgctagaatacatcaaaggagtaacagaaaccctggtgagcacagaaactcaggacagccacaaagagaatggaaggaaacatcacaactccaccaccctatccccagctgagatgagccagaaacccagaggaaactttccctataggaaaaaggcaagcaagaggattccagtagcctccaccaacaccttggacacccacagtcctcactactggagtccttgtagtcttcactggcactaagtccagctgagggagctgcctacaggccacacagccacactcacctcagagaaggaactaatactgtgctctattccctgtagcccacatggcaactgtgctatatcatcttagaactggaactactgctgaagtgtgattttctctgagggtgagcaggcttgacacccctgcctccataaggctaagctgcctccaaaccaccccaaaccagtggccacagccaagctgccagcagctgttaatgcctttccccatggagccaaacagtgaaaactgctctacctgccctccctcaccttcacctgccctctcccttcacctgccctcttgtgctagagatgaagcaatacattccctcctggggaaacagtgctttggcagaacagctccatctgcttctctccgctgcaactgtacactgcttctaggggtctgagccaaaatggcacagtatctcccaaggaaatagtgctttggtaggaccctgtatcccaggtaaatggtgcctgggccacacagaacagtcatgcctgagttaaagtgtcacattgccccttggggaatcattgccttggtcaagttaaacaactgtgcatcccagggctgagctgatgtagtatcttgtgtcccaaggaaacagagtagaacatgacctaagacagtctaccctactggacaatctagtaccctgctttcctgaagctggactagcccactagagtctgaactgctaagacctgctgtttcctggggagtggactcatcactgtgctactccctgccctccaggacccaaacaatacccatgctcagtcattctagggtacttgctgccactgcgcctggccacatggagtctgggatacagatatgccccaccattccaaggtctaaatttaccactacatagttcttcattctcagggacctaagctgccactgaaccctattggcttaggctcctaaattatagctgtaccatgcatgctgtgctcaaacccctaaaactctgcttctttcccagagctgagccagggctgtatcctattccccaggggtagaatcacagctacaacctgacccactgaatcaaagctggtaggggctgcctaacagtcatagattctggctctgtgggaaacctatatttgacccagctacagagagtgaacctgtaccccaggacccaagagccacaataggcttgtgaaactctgatattagcaccctgactccatagccacttcaagtaccaatccctggaactcaaagcaatggaactgcttgtaggccatgtaagagggatcctcttgtttaattatccccattgtgaggaaaatcagaataggaggaccccaaaagccctgccactgaggacattaacaacctatgttgtcactgccactaccatacccctttttttttaattatactttaagttttagggtacatgtgcacaatgtgcaggtttattacatatgtatacatgtgccatgttactgtgcggcacccattaactcgtcatttacattaggtatatctcctaatgctatccctccccctgcccccaccccacaacaggccccggtgtgtgatgttccccttcctgtgtccatgtgttctcattgttcaattcccacctatgagtgagaacacgcggtgtttggttttttgtccttgcaataatttgctgagaatgatggtttccagcttcatccatgcccctacaaaggacatgaactcatccttttttatggctgcatagtattccatggtgtatatgtgtcacattttcttaatccagtctatcattgttggatatatgggttggttccaagtctttgatattgtgaatagtgccgcaataaacatacatgtgcatgtgtctttatagcagcatgatttataatcctttgagtatatacccagtaatgggatggctgggtcaaatggtatttctaactctagatccctgaggaattgccacactgacttccacaatggttgaactagtttacattcccaccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcaccaccatacacttttacagcctaagtcattcaggcatccacagttactgttgacactgaatgcagctgaagaaactgcatagatactataccactgaacctacctggaaacaaagtcaccacacttttcctaattagcacactaagatccaactacaggtgaaagtctttctctgcaaaagccactctagaaagtctggaagaggcaatttttccaccaaatgcatagacattgatgtagaaacacaagaaatatgaaaaagcaaagaaatatgtcaatgccaaaggaacaaaataactccctagtaacaaaccctaatgacaagaaaatcaatgaattgccagaaaaggaatacaaactagtactcttaagaaactcaacaagatacaagaaaatacagatagacaattcaacaaaatcagaaaaagaatttattatataaattagaaattcaacagagatagatattataaaaaataattcaattaataaaataaaaaatacaataggcagcttcaagaacagacttaagtatagaaaacaatctctgaacctaaaaataggttatttaaaattacttagctagagagaaaaaaaaataagaaagaaaaagagtttttaaaaaagactacaagacttataggacaccattaagtgaacaaattttcatattatggcagttccagaaggaaaagatgtattaaaaaaaaaacctaatttaattatctaatagctgaaaatttcacaagtctggatagagatgtgtatatacagatccaggaaactcaaaggttcccgaatagattcaagccctgatgcacattatagttcaattgtcaaagtcaaagacaaagcaagaattctaaaaacaacaagagaaatgtgtcacagtacatttaagggaatccccattagactaacagaagactttcagcagaaccttatagaccaggaaagaacagaaagctacattcaaagtactgaaggaaaaaaactgtcagtcaaggatactatatccagcaaatatatcctttagaaatgaggaagaaataaaacgtttctcagagaagtaaaaacagggaattcatcaccactagaacagttttacaagaaattctaaagggactcctgcatctggaagcaaaaaatgattatcactactaagaaaacacacaaaagtataaaactcactggtagaggctgagcatggtggcttacgcctataatcccagaattttgggagtccaaggtgggcagatcacctgaggttgggagttcaagaccagcctgactaacatggagaaatcctgtctctactcaacacacaaaattagctgggtgtggtggcacatgcctgtaatcccagctacttgggaggctgaggcaggagaatcacttgtacccaggaggtggaggttgcagtgagctgagatcgtgccattgcattccagcctgggcaacaagagtgaaactcatctcaaaaacaaacaacaacaacaacaacaacaacaaactcactagtagagcagatacacagaaaaaaagagaaaagaagcaaaacttatcactacagaaaatcactaaaccacaatgataaataataagagaagaaagaacaaaggatatgcaaaataaccagaaaatagttaacaaaacgacagaagcaagtcatgacttatcaataataaccttgaatgttaacagaataaattccccacttaaagacatagactgacttaattgatttaaaacaaaagaaaacaaaaacatgatccaactatatgctttctataagaaattcacttcactactaaggatacatacagattaagagcaaaggaatagaaaaagatactccatgcaaataaaaataaaaagcgagcaggagtagctttacttgtatcagataaaacagactttaagtgaaaaaactgtaaaaagagacaaagaggatcatcatataatgataaaggaatcaattcagcaagaagctacaacagttatatatgcatccaacactggaacacattgatatataaattaaatagtattcaatccaaagggagagatagaccccaatgccataatagttggggaccccactctcatcactggataggccatctagaaagaaaatcaacaacgaaacattgagtttatactgcattttagctcaaatggacctagcagacatttacagaacatttcaactgacagtggcagaatacatattattttcatcagcacatggaacatcctcaaggacagatcacaaaggccacaaaataagtctcgacaaatttaaaagaagtgaaatcatatcaagtatcttttctgaacacaatggaataaaactagaaatcaataacaagagggacttttggaagctctatgaatacaacatgctcctgtataaccaaagactcaatacagaaattaagaagaaaatttaaaaatttatgaaaatggaagcacaacatatcaaaacttatgagatacagcaaaaacagtgctaagagaaaagtttataacaataaacacatcaaaagagtagaaagactttaaataaataatctaacagtgcaagaacaaaaatgaaaacaagaacaaaccaaacccaaaattagtacaaggaaagaaataacaaagatcagaggagaaataaatgaaattgagactaaaacttacaaaagatcaatttttaaaactttttttgaaaagataacaaaattaacaaaccacgagctaaactaaccaagaaaaatgtcccaaataaataaaattagaaacaaaaagagagaccttacaactgataacccacatatacaaaagatcattagagactagtacaaacaactgtacacccacaaattggaaaaccaaacagaaacaaattcctagacaacctaacaagattgaacctagaagaaatagaaaacctaaacacaccaattacaagcaacaagttgaatcaataattttaaaaatgttctatcaaagaaaagcccaggacctgatagcttcactactgaattctaccaaacatttaaagaagaactaatgcccatccttctcaaactcttctagaaaataaaagagaagggaattctttcaagctgattctacaagaccattattaccctgataccaagccagataaggacacaacaaaaaaaggccaaaatccctgatgaacatcgatgcaaacatcctcaacaaaatactagcaagttgaatccagcatcacattaaaaagaacattcaccatgatcaagtgggatttatcccagcgatgcaaggacggttcaacatatgctaatcaataaatgtgatacttcacattaacaaaatgaaagacaaacaccatatgatcatctcaatagatgcagaaaaagaaaagaaaattcaacatcccttcctgataaaaaccctgaacaaactaagtatagaataagtgcacctcaacatagtgaaggccatatatgacaaatccatacctaacattatactgaacagggaatagctaaaagcttttcttctaagaactagaacaagaccatgatgcccactcccaccactgttattcaacataacattggaagtcctagccagagcaattaggcaagagaaagaaataaagggcattcaaaatggaaaggaagaagtcaaattgtccctgtttacagatgacataatcttaaatacagaaacccatataagctgtaccaaaacattcttagaatgagacaacaaaatcagtaaagttgcaggatacaaattaacatacaaaaatcagtaccatttctatacaccaacaatgaactagtgaaaaaataaagcaagaaagcaaccttacttacaatagctacagaaagaaaatataaaatacctaggaataaatctaaccaaggaagcaaaagatctctacaattaaatgacaggacactgataaaagaaattgaagatctggttacaaaaaaaggaaaatatcccatattcatgaattggaagaacttatattgttaaaatgacaatgctaccaaaaacaatttacagatttgatgtaaaccttttcaaaataccaatatcattcttcacaggattagaaaaaatcctaaaatttatgtggaaccactgaagaccccaaatagccaaagcaatccccagcaaaaagaacaaagctggaggtagcacattatctgactttaaaatatacaagaaagtgataataactaaatcatcatgttactggagtaaaaacaaacacatagaccagtggaacagaacagataaatcagaagtaaatcctttaattatagcaaactgatttttgacaaaatgccaaaaacattgagtgtgcaaaggacagtctattcataaatgatgctgggaaaactggatatccatatgcagaaaaaatgaaactagacctctgtctctcacatatacaagaatcaaatcaaaatggactaaataattaaatgtaaggcctcgaactataaaactaagaggaaaacattggggaaaatgcttctgggcattggtctgggcaaagattttttggataagacctcaaatataaaggcaacaaaggttaaaatagacaaatgggattatatcaagctaaaaagcatctgtacagcaaaggagacaatcaacagaatgaagagacagcccacagaatgggagaaaatatttgcaaactatccatttgacaagggattaataaccaaaatatataaggaactcaaacaactcaatagcagaaatgctaataattcagttttaaactgggcaaaagacctgaatagacatttcttaaaaggagacatacaaatggacaagaggcatatgaaaaaatgctcagcatccgtaatcctcagggaaatgcaaatcacaaccacagtgagataccatctcaccacagttataatggctactatgaaaaagacaaacaataacagatgctggagaggatacagtaaaagaggaatgctagtgtactgatagtgggaatataaattagtacagccattatggaaaacggtatggaggttcttcaaaaaaactaaaaatatctacaatgtgacccagcaatcctgctgctgggtatatatctgaaagaaaggaaatcaggatattgaagagatatctgcatacccatgtttactgcagcactattcataatagccaagatatggaatcaacctaagtgtccatcagctatggatgaaaagataaagaaaatgtggtatatacacacaatgaaatactattccgcttattttatacaattaagcctaaaatatattttaaaaaataataaaatcctatttgcagcaacatggaactggaggtcattatttttatgtgaaataagcccaacacagacaaatattggctgggctaagtggctcatatctggaatcccagcaatttgggaggctgagggaggattatttgagcccaggagtttgagaccagcctgggtaatatggcaagattctatctctataaaaaaattaactggctgtcctagctacttggaagaccaaagtgggaagatcgcttgagcccagaaaattgaggctgcagagggccgtgtctgtgccattttaactttactccagcctaggtgacagactgagaccctttctcaaaaaaaaaaaaaagaagaagaagaaaaataataagaatgacagacaaatattacattctctcactcctatgtggaagcttaaaagtgtggatctcatggaggtagaaagttgatgggtgctactagagcctggaaagggtggcaagaggggtgaagagaggttggttaatagatataaaaagacagctagatagaaggaataagttctagtgtttgatagcacagcagggtgattatagttaacaataatttgttacatatttcaaaatagctgcaagagagaatttgaaatgttcctaacacaaagaaatgataaatgttcaaggtgctggatatcctaattaccttgatttgatcattgcacgttgtatgcatgtactaaagtatcacatgagcctataaatatgtataattattatgtatcaataataaaaaacattaagtttaaaatatatctttaataaattaaacttttgttaaaagcccaaattatagtaaataaacccttctgcatacaaaaagtgatctattagccactgaaaatcttataagagagtttttatgacagacttatgagcaataataagtattttaaaatataaatcagatcatgtcatgccttggcctaaaactcttcattgtttaacagttactcttatgagaaattccagtctcccagccaaggtctatgaaactcttcaaaattgactcttgtccacttctacctcctcaccaattatcaacctcactaccccagtcactttggccttttttcctctttctgatacatcatgagcttattatggcaacaagtcttttatatttgttaacttctctacctggagtacttttcccaaaatattttgcaaggtgggctcttgcttgacatttaactctcagctcaaatatcacctcctccagatgcctcctctaattgtcctttacaccaataacctctgacacattcatatgttttacagtcttaggaatatcctcaatgcctgacttaccatattcatttattggctcccatatttatttccccctctcccaaataaaataaaagctcaatgagagcaatatcttgtctttcctaaaccattgcttggcacatattaaatgctcaataaatatctgttgcacaaatgaataaacttaaataaataaaacacatctttgccttaataccaagttatttttaaatcatatccttatgtaatatcgaatccataagactcaattatctggggtttatttgacaaatttgattatcttatttgggggttaataccatgaatggctaaaaataggccaattgccaagcagagcacacaagcaaatatgatccctccccaggatgcttgccatccaaattacaagcattgaaaaatcttggcaaggcgcctatgctaataagaaagtgatccaatattcatgagaagaacttgaaaaactattatttttgcctgcaatcttcttggcttttccataattaatatgtcattatcatcagaaggctaagagatcaagagtggtaaaagcaacctttcatgtaatactcatagggacaatggtatttagcaaatatcacattgacttctggtaagagaaataatccagaatctgtggttgctagaaacctagtatatggaaaaaatagaggggcagttggcatcaagacagaaaggtagggttttaaagctgatctagaggtagaaaaaaacacattctagagattcctgaagaaacaaattccaagtactcattgtcatgaaaaacggtatgatggagtcctaccctctgtctgtattgttcttttttaaatagatcttcctggttaggtcaggaagaagctattcttgaatgccagttaatacattcctccatttactcaacattctatccctacaccaaattagctcagtagaaaggctatctagactatctactacctaggtcataatacattagcaacctgtacaaatgtcttttcagagtttcagtttatagcatgccgtggtttgttatccagggtgaatctaggaaacaattagatctataatctcacagcaaacttcatttgactatatttgcaaatgttatcaactatgttatttttttaccatcatatatataacgattgatataaaaagtttttcttacagttaggaaaaatttgtctctcctgacaaagtggtattcttccttttgcaactaatggcagttatgtaacttgcttctcttagatggccttggccatctaagaagctcagagcagaactaacttgtttaggtcgtctagaatgacttcttccgatccctatttttctctgcttaaacttgttgttcagttctgttaggacttttgttttgttttgttttttacatatatgccttttctcattagttggttaaaatacgcttttaaagtgtataagataaaaatagtagagccagacacggtgccttacgcctgtaatcccagcactttgggaggccaaggtgggcagatcatctgaggtcaggagttcgagaccagcctggccaagatggtgaaaccccatctctactaaaaaatacaaaaattagccaggcgtggtggcacacgcctgtaatcccggctactcaagaggctgaggcaggagagtcgcttgaacccaggaggcagaggttgcagtgagccgagactgtgccactgcactccagcctgggcaacaagagtgaaactccgtcccaaaacaaaaaacaaaaaaaaagagtaaataattttgaaattttaagctcccttttaccaaaaaagggttctgacttctggccagaatgtagtaaatgtcaagaaatcagtcacagctgaggtagtgccaggaatttggtgtgggggacaggaggagacaagcaaagactatttaaaaacaatgaattttagcctgtctataagtactcttttctatgaaaacataaaaggaaatttcccttacaaatgttgattgataaacatgaacgtctatatggaaaataatgcgatatctgagctaaaaggactcttagtgaactctgatccaatctccttgatttgaggatagggaaaagtgtaatccctaaaagattaaatgatatttccaaagaaacaacaagttggtaattaagtccggcctgaaatctggggcttctgcttcccaggttatgagctttctaacactccaagaactgtgaaccctggagggaaggttgtaatctgactttaactcctgaggacatgtggatatgcccttcagggtccagggacatttgggttgcacattaacagttaaaatatgctaaagcaccgcattttctccaactccattcaatgcctaaggtttattgtttgttcagttttagccaactatatttcctgagtgtttcaaaaggcagcaaggtggcgaggatacaagggaaagccgctacacattcaacataggaatacaaagattatagtagaattctacgcatcaaattccaattcaaatttcttctggggtcagtgtcagtatctcccacttcctcctgacacatcctgagctgaagatcccttttaaattttctttctaagaaaaaaaaaaatataggtttattgatctcctttaaatgatagctttagaataacatgtcaaattatttctgtttcttgacttattctaggaaaaaagacaaagaaataagatattcatataaatgaaaagtttcacagccggcaaccaactaattggtatatatttaaacacatttaagatattacttgattacattcaataggcataatgtccatataagaacaatggttttgtttggaacatataaaagtgatagttctgtaacatgtatttatttaactttttattttgagataattatagattcacttgcagtggtaagaaataatatagacagatcttttgtatccatcacccagtttctcccaatggtaaatcaagatattgacattgatacaatccacctcagatttcaccatgttagatataagttctaaatttctcatcaaagaataaatatgccagtatgttcaattctttgccttctacttttaaacttaacttcctcgtaaagtaacctttttcgattacctactccaccccgactcattccaattcctactccaccccaactcattccgatcacctactccaccctgactcattctgattacctgctacctgctctgccctgactcattctccacgctgcataaccattttttttccctccaaagcactcaccccctcactctctttaaattagccaattggaattagtttcgcctgcgtggtctaatcctagccaacaggggaacgacacggcagcaggggccatgtgcctcagggataagaacaccttcccctcccttgtccaagtgtgcgctcaccattgttccatctgtaagggcgtacccttctgtagaagtaacttgccttgctgagaattaaaagaaaattttatattcgatgccgtttcttttgcggcaccgaaactttatatataacaaccactttgacattcatttatataaagatcaatttttaatagctacaatctatagagcacttctatatgccagaccaactgctcactgatgaacaaacattcttctagttcattcctacaaaaaacaatttaccagtggaggcaatagtgaggactgtagcttagaagctttcatgctacaatgtagtatatgctacagtgtagtaccctatagctgtatgggtggttcattttaaaaattgtatatgcagccattcctcaataggctcaaaataaatattgacagaaataggtaagtaaatcaaaagagaaaatcaaagccaggaatcaaaagaagaggcaaattgggttaatatgattcaatttacgtctgggcttcttggtagacaggacaaaaaggtaaacagaatgagatatgcaatcctttttgtcaaaaggggaaactcatattgatcctttaagatatagatgtttaaaaatatgtctatgtctgtgcacatacccttatgctagctccagctcagttttttaaaataatcttttcagtcagagtttatgaacatccaaataaaactgtgtcaacacatgcttaatacatcagtaaaactatttttaataatgtactctcctattgaatatgggttggttttctgacttgctatggcccattgagtgcacagatgtcacagtgttctacttccaggtagtccttaacaaggctggcagcttctactttgaaactttccaaaaaattagcttccatgatgtaaaaaaaaaaaaaaaaaaaaaaaaaaaggccaatccagaatactacatgataaacacttgtgaagagactgaggtcatgtgcacagcaccaatgcacagatacgagtgaatccgttgatcttccagggcagcatagccgaaagctgaatgcagcctagtgattgacccagcctacaccaaatggagcggaacaactacccagccaagccacgccccaattcctgacctacagaaccttgaaaaataatgaatcactgttggtttaagcaacagaagttttgaggtagtctattacacagcaatcaataactgaaacaataacccaaactgataacctgaaaattcattttgtaaacctgcatctaaacttggtacaataattaaacattttctgtgcaagtagtccctcttatatgactagaatgtgtggaatgcctaggagcagcttttccaaatgaattcatcaataaacataaaacataaaatgaactgctctagttttcccagagattctgcctagaacagactgccctaggacagatgattaagttagtttgggtccaattcatgactacataacatggagttagttatgtcttaggctacgtcccttcaggcaacttggagcctcccagggttaaagaagctctgccaaaactcaaaatcaatagggccatttaaatgatgacatccccagtgggtaaagatatttgactccacacatcaatggcatgagctactgtcatgggcattcgtcaataggttgaagatctcattaaagctttttaatttctgcttagtggtattaggatttaattgatgccaaagacactgcctgtcactatacagtgatgttgtggcagtcagtagagaatgtcttacacacagtcctagaagaccttcctagaaaggccagggcagttctactggctgcatttcctggcttgacaggctactgctactttatagtagctctctctatgttgttctaccttcccatcatccgtgcacccatcttcttttaccagcaacccaattttctgaaaaactactccatctttattcttagtccatgttgctcagaagggtttgattctacccacagcttcaggcatgggcacaccacccagatcaggttgatcaccctggacatataactcaagacagtgtcaatgagatcaaaactttgaactctcaccaatactattggaaatgagaaactctattgtttcccactgggttgctaaactggtagaatggaatgggtatatataactgacagcctttttgccattccagggagataaaccctaagaacaaacaatgcatagatcacttgatcttctggatccagcagttctagaagtcatacgtgtctatattttttcagtatataagccaataaaatatcattttcatctaggctgttttgagttgtatttgctatctcttgcaatcattctcagaaactgccaaaagatgggctgctgcacaactatgggatgatggaatgccatttattttctgggacagtgcaatttattacaatttattacactccctttctgagccatagatcagaaagtacccgggcgttaagacaacagcacttcaaaaaacaatatcatacttgatcttcataaagttaagtgagcaaacaaggaaactaagacattaatgagacatgtggttcaaaagtcatccatcaaatcaaatatggcaccaagactggaaaccaagtcttcatgaaatgcgaggtttctgttgcttgaatcaatggaccttaaaggtgatttggtcttatggctccccaatgtcagtccatggattgggatctgttgccagagtatgttcaaatcatcaatagtccacagagtaatgagaaaaataaagaaactttgataggttttaatggagcaatttcatttcacttttaaagcctgaaatttcatccttccaggtttgtttggttttttcttttggtgttaacatatcctctttttgaaataatagcaatagtagatgtaaatcatcttttttggctaaatataaagtaagcaagcccatagcctcccctggaaggcactgccattgtttccaatactctcagctttaacactgacagctacccttgctctctttctcactgacacccaccaactcaaccagccctctcccaccacacaccctttctcaggtcacctctgtgctctccacccttggagctttacctctgggtaattcccttgtcttttgtaatgtatattagagtgtatattagagtgtaatgtatattagacgtctataactcctgctattactctgctcagcaccttcttaggacagaagcagctatcctttctcctgagaaggtgggaaaaaggcaaattatgcatacttataaataaatatttgttggtctcaaacaagtaaatttataaacattgatactaacattactggaagcataaaagcattagaaagacattaaatgccctacagtagagtgaaaattaaattctgccatctaggagaatagtatttagtcattaaagttatgattataaatactttgtaataatatgcgtaaatgcatatgatataaggttaagtgaaaagatacataactacaaaatacaactatgttaaaatatccatgcatggattaaaaaaatacagctttaactgcatagtggagttaccggtaatgtctacttttatatttatagaaatctctgttgtccagattttctgcaatgggtacatatgacttttgatggggttcagaacatgctaccacaaaacatggcaccttggcattttgaatattttaagctgaaggagtctgagaaacagcatgtgctggaaggactctctgaagcaggtcagaagccccttgtgtgagaggtccctccctaaacccagagaaaaggagcatccttatctctgaagatggagggacacacggagaagaaactccaggaaccagccttggtaagtttcccctagtttactacacttagttcatatgcttttccacaagtttccactcttcatcaaacctagtataaaagcactcaggtttaactgattcatcagattttccttccttatgaatgctctagtgacacataaaacttgtattaaatacatttgtatgcttttctcttattaatctgtcttttgttatagagccctagccaagaaactaaaatggttaaagggaagatttttcctacactttaaagtgtacaaatatatatttattaaagttagttccaattattatgtagccaatatttactgattactctactctgtagatgccaagaaagccatactctttcctgatagtttcctttgtgtgacaagatttgccacagatgtaggcaatgttggtattatacttttcttgacagctagaataacttctgctaagctaggcaaccacatctctccaagccatccttaatgcctaatgactgccactgcacctgacctagctccagggctgaccctttcatgtttaccccaaggccatgcccatctgggaaaccacctgggcaggtaccttccaaccaaattaaagtcaaggattccatccactatcactaaactagcacaaaccaagagagagaaatcaaggcaccacataggggttaggacaagtaatcaaagtcaggtagaaatcccagaagggtggtatacaatttatatttccctagtgaggcccattctagaataatgggaaaggttcactgttgtcagaatgccaagaatgaattctctgaatctggccttccctgaaatcaacacttaggttctgacaacctctaaattcatcctcactaactacatcaaacatttagcatgctttttattgtggggatgggggttgcttttgtttgatttggtttatctggcatctgaaacaaaagatgggaaaggatgacattcattcttaacctcgtgtatagttaaccacatcaaaaaaggctattgttagatacaaataaacgttaacatacattagttccaaaaggctaaagcctttcaggtgaacattattggacactttctcccctgtgccagacaaaactatgcatggcttattcccagagtcaccccgtcctttccaaggcattctatgctgcctcagggatgcaaacaattatggtacttccaggagagaaggagcacataaattctgtcaccccttgaccccaggatccaatttcacagcaatgggtgaaaggattttttagtcaagagatgatgtgagacgcacagataccccttggagtcatttgggtgacagcattaaagagaatgaaatgagctatcttgaaatggaggccaagtgcagtcactgcatctggaaagttaggctccttgatattcaaagctctggggctcggcaaaaaattcaaagagcttttagtattcaaaacaaaacaaaaaaaaacaaacaaaaaaacaaaaaacactctttaaaaaattaaaatattcaaaactgtggaaaacttgcaagaatcatatcatgaacatcccatactgtcttcccaagattcatccatttgctattattttgccatatttgctttatctcttcctcctcctctgctccccttccctcaaacaaacaaatgaaaagtggtttttgctaaaccatttcggtgtaggtgtgaacattaaaagcttctaggaattacagtagtctctcacacatacaatgatcaaaatcagggactttaacgttgatagaatactatcttacacgtagtccatatttacttttcttcaatcccgagtgtcctgtatggccactttcctccagtctaggatcgcactggcttttagctgtcatgtctctttagcctccttgaagctggaatactttctcagccttcctttgcccatcatgtcattaacattcttgaagaggacaggcctgtggcttttcagagaatctatgctggtctgactgttatatgaggattagattcatagtacatgtttttgaaaggcatactacctaagtgatagcatatccttctcattgcattacatcagttggcacctgatgaaacttggtcccattcttgatgtgttaaccttgattccttaaataaggtgttttctgccagattacctcactgtatgtgtgtgtatgtgcaggtattcctctttttcccttttataattaataatgtatgggaagacttttttctgactgtgtaaacaccctgctaatcaacaagctttcactcaatggtttaacacctattgacaattctactctgaatcaattattactataatagttgtaaaaaagtgatttttctaactctattatttctttcacagcaattagttggttttctagtgcaagaaacagctgccctttctcccttctttccttcctttccctccttccttccttcctttctttctttctttctttctttctttctttctttctttctttctttctttctttctttctttctttcttctttcttttggttatatcttactcatttgattcttaagtgtcccatttcaagctggttcctgtgtcattcagacaggtcctcattttttttttaatcagtttttattttctggcacaacaaaatgttccaggcttttcttgtcctttccctgctctgaaactgcaattagtcattgctctaagcaggggtccccatccccaacctccaggctgcagactggtaccagtctgtggcctgttaggaactggctgcacactaggaggtgagcagcgggcaggggaacctaactgcctgatctccgcctcctgtcaggtcagctgcattagattctcatggcaacattaaccctattgtgaactgcgcatactcattatgagaatctaactaatgcctgatgattttagatggaacagtttcatcctgaaactatccccgctcccctgccaccgatggaaaaattgtcttctatgaaaccggtccctggtgccaaaaaggttggggaccactgttctaagggcccttatttttagtggggaatgctatttagaaagcaagagctgggcactcagtgtgttcactgctgctaggagtgttattgcttgcaggccctttaagaggacaagtaagaattataaatatatattgagtcatgtcttcctattgatacttctaatctccatccaatagctcaggctcttccttgcctttccccaatccacagttgtactgccctccttccacagtgataagcctgactccccacaaaataatacatttacttaatcctacaatggatacaaagtaatttcagaattgtcccacaaataacacaaccaagaacaaatgtataaagttcaagatttctttccagtacttctgttgtttgattgaaggccatgcccatctgggaaaccacctgggcaggtaccttccaaccaaattgaagtcaaggtactgcattcaaaataacttgaatcagtatttttttcctatgtgtaatcatgtcatccatttgatatatagttaggttcatttactctgtactcaatttcccccatcttgttatttaatgttatttcggaatatacaaaccatgaacatggtttcaaactcaaaactatataaaaaggtattcagagaagtactacatcactgtcttccttccctaactcttctaatgctattcccaccctgtagatgaccaatttcatatcttctagtttatccttcctgtgtatccttttgcaaaaataatcagacacatagataaagacatttttatttccccttctttctacctgaaatgcagcatgctatatatagtcttccacattttgctttttgcactaccaatatcttctggtgatcactccaatcccgattcacagggatcttcctcatcctattttacagcacactactgcattaatgtattatggctcattcaaacaatctcctcattacaacataaccacgatgatgctgcacatattattatgagagaagttgaacatattttcatatacttaaggacccttttttatcaatttttgtgaactttctaggtctttgctgcttttctatcggatttatggtctctttagtctcctcaacgtgtagtaactttctatatattagcaatattagcattttatcagaaatacatcttgcaactatttcctcctggtttattacgtgtggtttatggttttttgccatgccaaagaggattttgtttaatttctaactttacacaatcagattttactacatctgaagtttgaattgtgaaaaacctttccttgtgcttttcctttttgttataaagcaatttcttatactggctaatttttaagtatccctcattacactatacatgggaatgtatgtaagaagaaaatcctatttgcctactgaccgctgggcaacttcaaaactgcatgacctttatttctgcaggcccttcatttcctagctgcatccctttcattttccctaaccccaggtttcctcagcaggccagcttcactagagagctgtaaactaaacctaaattactaaagaacacattactcactcatcataaccataggaatctttctctagagcaaataagaattagtagtacaaatctgttttataatcacatactttcacaaagcaagaatcaccaatagtatactttattgtctctcattgatgggtacattttctcttattatttttattatcaaataatccatgtttattttaggataaaattaaaactacagctaggcaaaaacaaatcaagatgttggaactgttaatattttagggcatatatgtaaacacacacctatttaaaaactctcttctttttatacctattaaaaaaaccctctgttctctactatacttgctattttgtaatctgtttccattttcatttaatataaacatctttccatgttactaagttgtctgcaaaggcattttaaaaggctacatggtattatactgtataaagacataaaatattgaaccaaatattgtgctcttaggatttaaaaaaaatatcgtaaacaactctgagaaaatttactcagacacacaccttcatgaatttgttcaaatgcttctttaagataaatacctaaatgtggaattgcaggattaaatagtacacaagattttcagggttttgatatacgtggtcaagttgccaccagcagtgtatggtgggttccctttacccacactgaacccacattagtgttatctttctctgtaatcctttttatctcctgatttagcaagactaaacaacagtgtaaagttctgcaaaagcaccagataagcaaatttagaacaaaacattactgatgtctgcccaaaactctgtaaacctgttcctaggctctaagctgtctattgaaatgtcctaagaaaccatttcactcagagaagaacatttttttcactcttcctgcacagctcagtctttacgatgttaaaatcctgtacaacttcctaacagcccttcacattcttcaggagcccgagtttggttctggttataaatgcataggatagatcccatacgggaagcatagacctaagaaatttatggaaaggaatttatgggaaagcttctctcatcagggctgtaccaattaaaaatccataaataattctcccttgtcagtttctgtataaacacattggccttagaaatttttacttcaggttctagtctaatggcctacacttctaaattatgcttttaattgaaaaacaataacatgcattttttttccagaaccatctgtgctttcccaagaacatgtaactactacagataaatccgctactttgaacaccctaattatccagtttagggttccaaaagcttaggaaaataatgccattcctgaaaaacagtacgtgatcagaaacacttgctttaaaattcgatatttggtgtgtgaagcttcttaacaagtgtttattaaactgcataatttcaaagcctggagtggtatattgcaatgttttcctcggagttgatcacatttgcatatctttttacacttcctgtgaaattaatattgccttttgtatctcgaacttagctaatataacttgccatttttacttttcactgctatgagtaatataaagtgaacccccaaagggacccctgcaacgcctacataagctttattctctcactgttgtattttttcatatgaatatattaaatcaagattaataaacctttgcagaatccactggtcctgcaaaaaggcaagattcataacggtaaaggctgctcagcaaataaaggaaacctgctcctaaaactggagccaaaggccggggttcatggagctcttgtcacatccaacagtgtgccagagactcttcacctcacaagaagtctttcaacagtcactcaataatatgtgcaaaagtggcttaaccaccaggataccaaaacccagccggtgattatcaggctgccttggctcagggatacatctttgtgagatgccaaaaactgaccataatcccaggattttaaaaatttcagctgggcttatggggatggaatgtgataataaagaaacaggatggtaggggctgaggaaaagtggaacatgatgagaggctcctaaaagcaaatcaaacacagaaaagggaaatctctctgaacactgcataccgcactgggcacaggagtcctcagttgagcatcccccactcattgggccccagcagctactttgcctagctaagaatctgctcaaagctcagggaaacctaaatggcaatacaaagaaagagttgggggcagcttcaagatagcaggctactggtacaaatactttgtgaggtcagaaaggctcactatcatgacttgtactgctgtcattgattctcctacttcaagatcatctccaacttggtcaagaggcagagtaatggggattcagggccacagttagggtgcagcaaatgaggtacaaaatttaagtagaactaaaaacaacctcagtagccaggtgtggtggccatgcctgaagtcctagctacatgggaggctgagataggaggatcacttgagcctaggagtttgaggctatagtgcactatgattatacctgtgaatagtcactgtactccagtctgagctacatagtgagatgcccatttcaaaagaaaagaaaaaaaaaagaaaaatcctcagtaatcaagataataatacttcagtgcaatctttttagaaaccaaaaaaatcatggtgaagaaaacacaattttaaataaatattaatgccctgccaaccatatttgagcctgcatggacacttctacctacatttttaatatattttaaaaattaatttttttggagaaccttaaagtcattgaagaaatactgaaaaattggaaagtaggtatattaaaacttacaatattaaatgtaaatattttatttatactaaaatcagaattcattataatttcactttcctgactctaatgggacaaagtaattttatttttatgttttgagatagagtctctctctgtcgcccaggctggagtgcagtcgtgcgatctcagctcaccacaacctccacctcctgggttcaagtgattcccttgcctcagccttccaagtagctgggactacaggtgcatgccaccacgctcggctaatatttgtatttttagtagagacgaagtttcactgtgttggccaggctaggggacaaagtaatttaaacatgttttcaaaacttacttctttgtttgtcttcttttcaatggaagaattaccatgtttgacattctcttatcacctagtgacaatcataaatgatttttaattaaacaatttactttctttaaattaattttattttgtttttccttagctttaggctccaaaatggcttggcactgtactaatccttatttaaaacttcaatgttttgttcatcatggatttttctggcatttatttgatttttgaaaaaaatggaattaaactatttgtcttgatcactaagtatgttgacattctcttaaactgtgcattaccttgttccatccaaatcaaagtcaaggatgtagccatctcagacaaataacataacaatgactttaagtgtggaaagaagcctaagatcttttattaagtgaaagaagtatgtggcagaataatatgtatagtatgggctcacttgcacttaagaaaggccagaaaaacattttaaagaataactctaagtcattacacatcaaataaacattgacggcaaaaggtaaaaagtgtagttactgaagcaagagtttctaaatcatggtgctgcaaaataatacactgggtgtccaagtagcagtaacaactaagtattaccctctgctaacatctgatatctttgaaagattgtctctacaataatgtcattctcattcacttgtagctaggtactttttttttctagagaaagagatgggatttcagcatgtgtactaggatgacaagcaaacactgtaggttcaaggaagttcatgggcatctcaacaatatgtgtggtggtgaaaaatacactgagaaccactcatctagctgctactgatcctattccataagctaggaatacgtcataagtactgttttgtcctcgcgttggggatttttgttttgttttgtttttttgtacctcctcagtatcctcctctgttaagtaatagcatttttgtttgctttttagccaggtttatggaggtataatttaaaaatagtaaaatttacacttttagtatatatttatatgaattctgacaaatgcatatagttatataacaaacaccacaatcaagatacagaacatttctatcatcccaaaaagttcccatgtactttgccatagtcaatctttaccctaattctccagcctctggcaactgctgatttgttttccctataattttgcctgttcaaaaacatcatataaatgcaatcataaaccatttatgtctgacttcttagtgtaaagcatttgagattcatccatttgatgcatatctcagtaatttatgcctttttattgctgaatggcatcctattttatggatataccacagtttatttatccatggtaataggatttggattatgatttcacaaatcacccatacttcctttcaggtcatgtggtttataaagggctgacccgaaagttccagagatgcccatagccaggcctgatcaaataacatattcagtcatcctgataatatggatggtttagagctgggcacatggtttgatgtaacaattttcgattcaagacaactgacagaactattggtaagaagttactgatggtataatggaaactgtttctggtagctattgcaccaccacaagggagccccaacttgaggataataaagccaacaggaagcaaagtgcaactaagtggatgagataccttcctaacctagtttgagcacctggatccagacatgcctaaagatctacctgtagacctgtcagttacatgaacctataaaattccttctagcctaggccaattttgattatatccctcattcctgaaactaaaatctcttgactctacagcatagaaagaaatctttcatcaaggaggttacaagagagtcttggaaacaagacacaaaaaatggttttgacatcagacaccccaactttaccacttactacttcctaagtatacaatgtcaagaattctctttactcctataaacctgtatttcctcatttccaaaatgcagagaataattccttacccattctaaaatattatcttgagaatcaaaaaaactaagttggttcaaatacaaaagaaaaataaaatgtatgattattatacacacaaaataatttgtatatgaaaaggagatattaagtgatgacggtgagagagaatcaagaggcattataaggatcaatgcagaactccagtgcttatataaggatcaatgaacaataattgtaactagaggtatttcttgagtatattcttgtgttaggcattgtgtcaggtattttacctacattatatcatttaacattctaaatatcactaaagtaactttttaaacccatttttgattaggcttagagaacataaaatactttttaagttaaagtactaactggcagaggccaaataaagacctaaatctggaccactgaaactagtgcacacttctaagttagatggaaggcatgaagcaaacactttggaaattaaaattcagttataaaaaccatcacaacacaattaatttagcaactacattcctttatacataattgtgccgagtgcatctaactcattaagatgtagaatgtttatgctgtcatataatattatcacatggtaataaatgaagttgcactatatctctaaacatctggatttcagagccaattttacacatttaattcagctatttggtgtcttaaacacatagcaaaaatacacaaggaaaaaatgattgtacatctggcatcaagatggctccaagaattggactgccaatgaggaagtcaggtttttctagcctatatcctctggaggataaatacccaaaatagtactgtttccaaagtaaccaaaatcaagaaaggagactccacaaaggaaacaagaatgaaaaagacaggcctagcccttttcaaaagctgagccttccctcccaggatccaaggtacttagggtttctcatacctgacaacctataaacgagaaagagtatcacttgtttgtccttccatttctcattttccagctttggtgcttatcaggttctccagaggtagcaaatttgtaagacatttcatctatttagattttcatttattcatccatcctttcagttactcagtgatgacttctatctgctgagccctgcactaatgatccaaaattcccaatcttcctgcctaggagagatagggagaggtagggaatatggcttctccattttctccttttcctttagtaaccaacctctactggaattaatcctttgagttcagctgggccttgagatccaacatgatttgttttaaaaatcaaggcaactattaatgtaaaaacaaaacaatacaagtattaggagaaaacatgagagaatttctgtacaactagatgtggggaaagcctttctaactataactcaaatccaaatgcaaaaaaaaaaagaaaaaaaaaagattgagaatttcaattacctgaaattttttaaaatttgcatagcaaaaaataccataagcaaaaataaaaaattaagtgcatgataggagaaaatatttataaaatatatcacagattaagctccaatcaccctaatatatattttaaaattcttggccaggcgcagtggctcacgcctgtacttcctagcactttgggaggctgaggtgggtggatcacaaggtcaggagttcaagaccagcctggccaagatggtgaaaccccatctctactaaaaatacaaaaatcagccaggcacggtggcaggcgcctgtaatcccagctactcaggaggctgaggcagagaattgcttgaacccgggaggcggaggttgcagtgagctgagatcacaccactgcactccagcctgagcaacagaacgagacttggtctaaaaaaaaaaaaaaaaaaattcttaaaacccatttttagaataagaaaaatagaaaaacaagtagttcacagatgatataggaattgcccttaaacatatgaaaatatgcttaattttacttataataagagaaaagcaaattaaaactacactaagaattataaccatattactctaacataagaggttatcaataggagaacctgggtgtggtgtacacaggaaccctttactatcttcacagcttttctgcaaaccgaaaactcttcttaacaaaaaagttgatccaaaaaaagtacattgagatactatttcttgcctatgagattgtcaaaagttgaaaaacttgacaatatactctattagcaaacagagtgtagagcaacagttcctctcaggcattgctagttagagtgcaaaagggtataacctgtgtaaagggaaatttggcattagttaacaaactatgtgtctatttccttttctatctttctacatacctatctatatatttacttaccagcaatgtcagttacagcattcaccctgaacatacaccttcaactgtatgaaaaaacgtggacataaaattattcactgtagtgttatttccagtaaaaaatactggaaagaatctaaatgccatccatagatacaatcaatagtagtcctttgtgtgaacaaccaatatacacatagaactactattcaactgtaataaggaatgaggaggatctttataaaattatatgaaataattgccaggataaaaaagcaaggtgaaagagtatacatagcatgctaacttctgtataaaaaggaagcgtatgtatatttgcttctttttataatgaagacatgaaggataaaccagaaactaatgaaaatattttcaaagagcgtgagtaaaaatggagctggaagggtagggatggagtgggactttcttgaacaatttttttttctagttttgacttgaaccaggtaagttttgacttgaaccaggtaagttttgacttgaaccatgtaaagttttacatattcgaaataaaaaatttaaaaaggatttataaagcaaaacctaaacttgcatacaggcaggacataaatggatctaatgatatatcacatcaacgtaaataatcacagaggaaaaaaataaattcaaataatttctgaagacagtattctgaatgtatatccttagtggaatattaggaaaaaaagaagtccaaataaatcttgaactttacttaatagattgattgtcaggaggggtattgatatagtaattctgaaactattttccgtgtactataggatagagcaaatgaatcgatacattaggatctcactgtggaataaaggagatacaaatatgaaatgagggaaagtgcggaagaatcctgtgatgttgaatttgaatggttgagttgtacatggtaacatacatgcatctacctatctgtctacttatctacctatctaatctatctaatctacctatcgcctagcggcaatggcaccccagtagcaatgaacccacctagcggccaaaactttctttctaaattccattctccagtaaagggagacagggcttgactgattcttgattggggtagggaaaatgtaaggtaaggttgatacatctttttttactccaggacatactcaaagactgatggagatatgtcaaaacgacataggaactagcatcaggggatcccactggctaaatgacagacaatttgagcctcacaaaagaataaggagctaagtatagttatatcattttgtggaacttcattgagctgtgtgcttataatttgtgtatttttttgtaggtatgctgtatttcaatatgaaatgtagtgtctttttttaagaaagctgtgatacaagcagcaaataagacatataatttactttagcagaaaggaagaccgtgctctatgaataaattgttctgattacactgatggtcatccatcctactatggaaacagaggtggagacctcttttggtaagaaacaacgtcagcccagaaatgtataataatacaaagagaaaaacatcattaggcacaaatcatcgatggacaatagaacccatgagtgaaaggttcttgggacacaaaatagttacccagtctcaaagtatcaccccacagatactaatttcaaggcaaaacaaaacacaaaacaaaaaaaaaccttaaaaatggagtgacctgaagaatatccaagatgaaacagcatcaccaaaactggcacaaacaaattatatgactctgctgtgatccactgtgaagcaggcaacattacctagatagtactttggcctacaatgaggaacaattggacagatccacattgtgtggtattccacaatcactgggtcggaatcttcaaaaatacagactcatgaaagagaaataaaaggcaggagaatattctagattaagagggtccaaagagacaaaataactaagtgaaatgtgtaatccttgattgtattctaaaaagaaaatggaaataaggaaaaagagacattacaaggtatgagggacattaatggaaacatttgaatatattagattacatatcaatgttaaatttcatgtggagagtgataacagtattatgattacatattcatcttaggaggtataaggtgaaatgtcagggggtaatatgatatctatgactgaaatgcaaatgattttttaaagtataataaatgagagaaaaaaagccaatgaacaattacaacaaaatgttaataactggatcctcaagggggaagagtaattgggatagactgtacaaaaattaatcaaagataactagcatattttgaatgctcactgttgtcaggccctatttagagaggtttgcaatactaactcatttaatccttgcaataactctatgtgattgataccacatatatccattttacagacaaaatggaaacctatagaagtaaaataacttgcccaggctagtaagtggagtagctggaatttgaagttaataaatttagagtcaaagtttattatcatatccacaatactactctgcccttcaaataaataagtctgtttagaggagcaaacacattaatcacaccaatcttatgattacatgcaactgatatctcctgtgtgcctaatgcagaattctggagggttcaattggttccaattagttctttttcctgtaccagaaaagaagatcagcaataactggaattctggggtggcatggagtgggggtgttaaattttacaaacacagcatccaaaaatagtatgttcagtcatgagtattatctttaaaatagagaatataaagaaagtctgaagatcaacatttaaatcaaagaaaaaagaacaaaagtacaggtgctttgaggtttagactatgctgaaaatgccattatagagcagtccatttcctcagtaggtagccccaaaagacccctgacacagtagaaattatatcattatacaattaatcagttttctttcacaatggcacaatggggtgccctctttaactcaacagagtaaccagctcaccaacagtatctagaaaagaggaaagtcacagaatggaaaaatagacacaaaaagctatggagaagagagactgaaacagacaaaggcggttgtactataaaagaaagcgagaaatggaaagggaaatgtcagcaatctaaggttaaaagagaaaagatcaggatataaaaagatgtagaagtctcttatgaaaaaaaaaaaaaaaaagggaggggaccagtgaagagatagaaatcatgaccagagtcgaagcttgaaaacgcagggcaacacacaaagagaagctgtaatagcagagccattcactcaatcattcatttcactcattcatttaatgcctaacatatgaagggtactttgtggagctttgagagacacaaaaatgactaagacaggacccctgccctcaaagagcccagctgttccaaatattctcattttggtatgctccaatttttaatgtaattttaattattgttgtcacaccttagctaatattttcatactcaacatgtacttccagaaattgcagcaactataccatctataaaagagggtaatcttggcagggagcggcggctcacacctgtaatcccagcactttgggaggctgagatgggtggatcacgaggtcaggagatcgagaccatcctgcccaacatggtgaaactccgtctctactaaaaatgcaaaaattagccaggcatggtggtgtgcacctgtattcccagttactcaggaggctgaggcaggagaatcgcttgaacccggaaggtggaggttgcagtgagccgagatcatgccactgcactccagtctgggcagcagagcgagactctgtctcgaaaaaaaaaaaaaaaaatgagggtaatcttaaatggatggcagctgccatacagaatgagttcattcgttgtggaacggaaacatgtttacatttctgatatgctgatagtatataatgcagtattgtgatgtggttctctgtatatatagatgctgtctatactttttttggatacagcacactccacatcattctattttatttttatcatcccattccagagaggaggcaaaggacaaggaagtctaaaggatgtggaaagacaaataaggaagttaaaaaacaggttttcattttctttacaatttcccagagggcttctatgacaaaaagctgtactgaacaacggaatgcgtatttgtcatagagtagctgagagtgaattctaggtaaacatacaagggagaggctcctagacagataccattgcctagtacctttcatttaaaagatacctagtgatatatgacttgggaaaaccagaaattgacctcccagcctgcctcagtatatggtctttgctcttaccaaggttggcttgctccctgaaaagacctgaaaattcaagtttgaaaaggtgtttcatatacctaatttagaacacacccctcctagatctataagagtaggtgagaagcatagaaatgaacacctattattttgaatgctcatcttctgattcctttaatgcactgtcccgccctttaccctctccccaaatctttgtggttcttttgggatttcaattgaggtgccccatctctccgccagagataggaatgtgactcaatctaaccaatcaaaatcttctgggggaagtgtatgaatctgcagttagagagaaggctttccgagatcttgggcacttaaattcacataagtctgaagctgcttagagatatttcttcccccaccacaaagactgtgactgaagaaaagatgaagaccacatggagaagaggaggactgtgaggggggtgagagcagaggcgaatttatcctgaagctactacatcttaagcttacaggtctttctctctttttttttttttttttcccagacggagtctcgctttgtcgcctaggctggagtgcagtggcgcaatcttggctcactgcaagctccgcctcccaggttcatgccattcttctgcctcagcctcccgagtagctgggactacaggcgcccaccaccacgcccggctaattttttgtattttttagcagagacggggtttcaccgtgttagccaggatggactccatctcctgacctcatgatccgccggccttggcctcccaaagtgctgggattacaggcatgagccaccatgcccggcccaggtctttctctagcgatgtgttcatatggtcatttataatcttcttatagagaaggctctccaaactgtatgagctttgggccacaaaatcctagattcacccctgggagagacagttgtgaagatacaataaggcacacatagccacccataacagaagccagtgtcaccccactggacctgcaattatgtgagccaatattcaccctttctttttatcttgggataatccaaatttggttttacccacttacaaagggaagaaaccggagattttaaagatagaaataaagtcatggctcgtaacttgctggcaggaaaaaatgagaaccaatgctgtttttgactttcagagtatctatcataagctatcattttgtttttgtccgcatttcagtatgtggtttaaaaggaagttccaacatcatatttgtaactagttataaggaaccggcagggaacagcctccagacatttttcaaatatatttttcctttaactggctataaaggacaataaggattaagttggcaccacaaaaagtcgcatttaatgatacccttttgtgtgttacccatttac

SEQ ID NO: 1965 - DNA, 568831 bp, Homo sapiens
cttcttggcactttgacttttccttatagaggttacagtttttgtgtcttgcattacgtggttatcgctgagggatgtagtagaaactacatggatggtttggagagttagaaggtttggatttaaattatagctctgctaattgttagccatataatcgtgtactggttacttagcctctctgaacttccaattcctcatctctaaaagagtgtaatagtatctttcacataacatgattgtggaaggtattctatggtcagtgtagtaaagcctcaaagcctgccatgttggccgggcacggtggctcaggcctgtaatcctagcactttgggaggccgaggcgggcaggtcacctgaggtcaggagctcgagaccaacctagccaacaaagcaaaatgctgtctctactaaaaatacaaaaattagctgggcatggtggcatgtgcctttagtcccagctacttgggaagctgaggcagtagaattgcttgaacccaggaggcagaggttgcagtgagctgagattgtgccaccactgtactctagcctgggcaacggagcaagactccaccaccacaaaacaaaacaaaacaaaacaaaacaaaacaaaacaaaggcctgccatgcagtgccactgaaaaatgttatctttgtgtgtgtgttgtttttttttttttttaggattctctgtcaacccattagctaataatgcactcactgtatttttccttttatttctccaaattatgacctatggtagacccagtgtttgctgactggctaaatatgttttaagttctttcagagaagaattatagcacaaaagtcccaactatttctatgacttttcagatcagttgccagtcagcctccagaaagactattgacttgcacagtcattagcagtatgtgaatctacttgtttctctgtgcacttaccaggatttaattttataacttgcatttgtctttgctaaattaatatgtaagaaatatcttattattgttttaatttgaatttctttgattactaaaaaaatttcccaagtagtggtttattgtttgtgtttctctttatatggattgtcatatgacaatatttagaaatagtctgggctgaagacgcttgatataaaagggctaaaaatgtttaatgttttgagctgcttaaatttatttatttgtgcattcattcattctctcagtctttattgagctacctactccgtgccaggcacgtgctgcacatactatgaagaaaaaaataaatgaatgaaaacagtgacttccaacctcttcatttaacatgtgtgatagttgaagtctagaaaagtgaggttaattacccagggccgtacagcttgttcagtagcagagccaaccatttatttgaacagtaatgattttaaatgttttgtgtccatagccttttaaaccatggcgacatcctggaaatttcagtattgtgatgttaaagaacatctctaaactgtgtctacgttgaaaaatcagagtcctgatttttggtttagaaaacatggtcacctggttcttcagttgtaaatataattccttcctagacctctctaatgcttaagtctaaattcattcttaaatgaataaacttaatattaaaataagatcaggaagtaaatcccaagccaagcatttcagaccagttgtgaacctcttttgacatgtttttggtaaatgagaagaactgatgacatatttccctatcaaataaaatagacaatttagatttaataaggcagttatcttcaggtaataaaaattcaactaacttgccataactatcttgtttaaagtcaattaagagcctcatatttctcacttgctgggtaaaatttaatagaacttcagttaagcatttattgcttatttaattcaaaattaagttaatcaccacagttggtaacaaccactgagtatttaattaacattcagcaaactatcttattaagtctaaattagatacagacaagtcttgtttatccccatcagtttgcaaacaccacctcccccacctcccatcccaaggggcctttggttttcctacagttttccttttttgattcatcatttttattttcttctacttaagacttcacttgggtgaaagaggagaagaggcagcagtccatcatgttatagaaactttgggctcgtagtataactgagaaactttttcaatcttttcttttttcttcaatcctattctattaacatttcgtttttcaaaaggtattgagcacattctctgtgagaggcttcttttaaaccctaaggaagctataaaagaggtcattctgacatatttggttttattttctcatcctagaaatgagaggattgggtttagtttatccgtgtaacacgtattattggcttgcagtgtgtaaggcacttagctgagtgtttggatacaccttgattcagacaaggcccctgctcttaaagaggacacagaccagtgtgaaagctgcaaagttcagctgtaggaacatgaaggtcctttagaatgctgtgattctgtaagacagtatttcccaaagtgttaaggctgttttattaagaaaagggtcctgtagccaagtaagtttggaaaagtccaagttaaacaaaattaaggaaatttcagtattgtgtatctttaccatgggattttgagactttaataaacgaatgcgcattctgacctcccggaaggtttgtttcccaaagttatttgatcatagaacccctgcaccccactactaccctttgtaccagagcatttcctgggttcagtgatgtaatatgctttggggaaagctgctgtgggccgtggaccctggccacgaacctcccacagcccagaaggggtactcagacattcaccctagtaactatgatacagggtcagaattctactttgtctgaaagttgtgcacatagagtgggtgattttagacatagagtcttttaactggagtggagggtatgtaaccaggacagcctttcctcatggaggagcgctgggtctagcgggagatagactgtgtaggcagagaggcctggagggttgccagagcatcatcgggaacagaataacagtgaaattctgacatggctgatttggtggagactccctaacacattgatataatgtagaccaatttttattatagcctgaatatggagaggtaagaggcaatgaattttttggcgcagaactttctgccttcggctttgttccaactgcgtgactgcccatctgcagaagtgattgttgattcacgtctgtaagacattttcattctcatgctttgtttggggcagagcctctgccttgtgaatcactcttatgagagggagtctcagtttcttttcttttcttttctttttttttttttttttttgagagggagtctcgctctattgcccaggctggagtgcagtggtatgatttcggctgactgcaacctccgcctcccaggctcaagcaattccactgcctcagcctcctgagtagctgggattacaggtgtgtcccaccatgcccagctaatttttttgtatttttagtagagatggggtttcaccacgttggccaggctggtctcaaacttccaaccttgtgatctgcccgcctcgatctcacaaagtgctgagattacaggtgtgagccaccatgcccagccgagggagtctcagcttcttcatcaacagcatcattctagtcagtctagtttccgtttaccttgtcatctaccacttcctccaacttaccttccccccagcttctcttattctggtgaatcacctgtgtcttcatttttcattcttattcatctgaatcatcttcttcatctaaggcaaggtacccttttatatcttcctggaaagacatctacttcatttaaaataatgctaccaatttcctcccctctggtagcaaccagcagatggaacatgctagatgaggtagaggataatctacaaatctggtctgccatatcatgggagatttcacgtaacagtgaattctttcagagcctctcagcaataccttccttgtttttcatatctgtatcaaaaggaacactggcaaacctgggttgtatttctcattccattttgggcttgaatttttctgagtctgagtctcagtttatctgtgtatgaaacgttagggttacgctatgtgtactctcagggccttttaactagaaaatgttgaatttgaatgtttactaagtcaacacaagctgcagtcaccctggattgcttgatcctccatgtacttttgagcctggcagtatgaggaaactcctgcagtgagcatagttcatgcctacacaaagtaggcattccatgaatattggttctcttccatcctgactgcttctggattcattttctttttattgccattgctttttagtcacccaagcttatctctttcttgtctacaccctcaatgctgtaaatcttcctttctcattctccatctggatagcttcctctctcctcacctttttcccttcaggctatgcctatggatgctgtccactctgaaacctcccaaagacaaatgattgcaatggaggcacagattgccgggtggtggtcctggccagctacaaatctttccaagagattagcaccatttctttatggaatcatattgttgttccatgagtgagaccaagtcttatcctcaaggatcccataatggaggtgagatgctttctttttgacacttagtggaaacaacagtccatgaggtatattatcaattggaaaggtggggtttttgctttctaggattgggcaatgcactactaggttctcagcgtggattcttgagtatctaggaaaactggtcatgtggaaagcttaagcttattttgcaggccttgaaaagacagcctgcatgtttcatttcactctctacccgaactgacacttcagggatgaaaatgtcagcagacagccagcaagtagccgactagagggcatgatgtgggctggtggtgcaactcttcaaggatgatatgccagagagggcagaacacagttaggacaaggccaaggatgtcattcccatgtggagaggccattggtaacctcggcgaggtttggttcttctccagtagagattttcagaagctaagaattcaccttgagagtcctttttgcttcctcttcttttgtattaaacaaactactcacctctcagtctttgcctttagtcctttggctattcctggttagataggcccaattccagaagcatctggaaaactctgctctaagtatgtagtgcttaagggccagagctctggagctacactgcctggatttgcattctggcctgccaaaaatacctcaacttgttgctcagtatttttaggcctctgttgcctcatccataaaataataataagaaaattacttatcttgttgtgaggattaaatgagttaatacatataaagcccttagaacagagcctgacatgtgataagtgcccattaaatattagccactgttattatgtgttacccttattaagtcacaaaatggcgatttggaaaagataatagagattatctaaatgattgtgttttttttgttattgttgtctttttaaataaacttttaattttggagtaattttaggttgatagaaaagtaaaaattgtacagggaattttcatatactactcacccacttgtcctcatttttgatgtcttacattactatggaacgtttgtcaaaactaagaaactgatgttggtacattactgtgaactaaactccaaactatttagatttcaccagcttttccactaagttcctctttctgttccaagatctagtccaggatacccagtttaggatcattttaaaactttcatcttctttaatatttatttacttatttttttgagacaaggtcttgctctgtcccctaggctggggtcccccacttgtgtgatcatagctcactgcagctttgaccttctgggttcaagcaatcctcccacctcagcctctggggtagctgggacaacaggtgcatgccaccacacccagataaatttttgtattttttgtagcgacagggtctcactgtgttgcccaggctggtttcaaacccttgggctctagccatcctcctgcctcagccttttaaactgctgggattacaggtgtaagccaccacgcctggcccatattccttaatatttagagaaggattccttatagaaaagcctattacaggtcaggcgcggtggctcatgcctgtaatcccagcactttgggaggctgaggcaggcagatcacctgaggtcaggagttcgaggccagcgtggctaacatggagaaagcccatctctatttaaaaaaatacaaaaattagccgggtgtggtggctcacgcctgtagtaccagctactcaggaggctgaggaaggaaaatcacttgaacctgagaggcagaggttgcagtgagctgagattgtgccattgtactccagcctgggcaacagagtgactccgtctcaaaaaaaacaaaaacaaaaaaaacaaacaaaaaaaaccaacctgggcagcagagtgactccatctcaaaaaaaaagtaagaaagaaaagcctactatgacgtataatgttgtaatcatgtaatctggagcagctgcggatgaagtcgagcaggatgggacccacctttttttcttcccctgatttatctccctgaagggctccagcaaagcagggcttaaaagtcactgcattgagtctccttgttcttaggggaagagactgaggcccccaaaagtgaagtgacaatgctgggagaagctggaagcccagagaagatcagaaaaggatcttcaagataccttgatcctgtccttgttgaataaatgagtgagcaactatcggggactcccaaaaattagggtttggatccaggctcctccacctttcccctcatttttccttatctgtaaagtgggttcactgatcagtaatgtctcataggacttaaccctcacaaaatgccacagttttaccctgtgaaagttaagcaaaccgttgtgcccacttttagcacagcctggaacgtagtaggttctcaatcaatgtttgaaaaagaagccttgaaaatcaggaaattctccccttagaacttatttcaagaagattgggacaagctggtgcaaaacaaagaagagttattcatgaggaaatctgtgacactcaggaatggaaccagtgtttgagtatctgataagcaggatatactgtctgtttttattcttggaggcttttatcatacaatactacattatgttacagtctgactttcacacaaattggatcccaaaacttcttacaggaattaaaaatacaaactcgtgggcagtatgtgttttataaattacagaaaacagtagtgtaaagacatggcatagcaagtgcagcgaagcgtgcgcaggcattgatacccgaggaacgcacgcatgaggcagcagggaaggcacagcatgctgggtgaggcagcaggtgcacagttctgtccctggagcctggagagatgggggaggagggacatctctagctgggaggctgggtgaaggagctgaaccctggagacataaataccctgtatatcttccttatcctgccatttatggtcttattgaagggggccagctgacttctgaaacctcatctccattgctttccctcactcttgtctttgttgcagcactttctgcatttggattaccctgccctgccatcattacctgtttgaatccaattgatcttcaaggtccagcatattaataccacctcttccatgaagcatgccttgatttctgcccatcccccctaagcaggaaatcatcacttcctcttatggttccatggccctttgtctgtactgcttgcatggcactgatcacttcttaccttctcttgtagttatcaatatgctcgtcttattttgggcttttacttctttaggaccttctcgtctgcctggaacttggcaaacagtgaacatttgttggatggatggacaggtttgacactgctgacactagactcaaatttagtttctttagagtagaattttattttattttatattttttgagtcagagtctcgctctgtcgctcagcctggagtgcagtcgtgggttcttggctcactgcaactccacctcctgggttcaggcgattctcctacctcagcctcccaagtagctgggattacaggtgcctcccaccatgcctggctagttttctttgtatttttagtagagatgacattttgccatgttgcccaggctggtgtgaaacccctgacctcaagtgagccgcctgcttggcctcccaaagtgctgggattacaggcgtgagccaccacgccccacctagagtagaattttaacttgcttatctttacatctcccatgctggcactgagaaggtgcacattcattcatttcacaataaagtttcaggcactatttcagcagtaaacagtccatttgttgatagttaacacagagaaaatagtactcattgggatgtgtttttatacttgtaaggtcgatctggatttgtttgtttgttttgatatgtaaggaccaagaaagaaaaggtttgctaatctacgagtatttctggtgtagaatgcaaatgctctcttattccttcaactggctttatactaaaaagagatcactgggctcagaaaggtcctatttttcagataatacagcagttccttactgacttgcctcaggagtaaactccttttccaatttttaaaaggatagtaccaggatgccactgtgctcatagttgggcttttttgtacatgttaatttttttttttttaaatatagtgacagaatgcataccactgaggtggtaaatggaaaaaataagtgcagtggagtatactgtctgtttcttggggccttttctattaatcacaggaggaagcatcagacatgaccagatgagagagccagatgacccaagttcatgccagatcaaaatcagaatggcaaaattgggaggagttgatgctgttgaattgagaaagcataaggttctcagagtgatagagctggaaggatcataaaggtcatctagtctaatggttctcaaactcgaaggaacattagggtcatcctggagagtttactgggccccgtctcagaggttctgatgctgtaaatcaggcgggacccctgaattttcatttctaagaagctcacaggtgctactaatgttgaagagaacctatgatctagttcaacttctgggatttcttgctttctttcttttgtaaaaaaaataaataaataaatttaaaaaagagtttttgaagatggggaaatgaggcctggaaatagaaaagatttgcctagagtcacacacactgtcaggtcaggtagagtcaaaatcaggcaccccgactcacagactgcttcacattgccatcagagattgtcctgcaacaatattatgtttagttctactgcagaatgataactggatcttaccccctttgcctgatctggccacaaacttgtttttcaggtctttccattaggctctcttcagctaattaaaaaaaaaaaaatcagttaacccacatttattgaccagtgctgtgtgttcacaactgtatttagactagtggtatagcagtgcagtagtctgaaaacattttctcatctgtaaacaaagacagtcatacctcctaggactgcaagaagtcactgaacatatacctggcccttagtgtacacattactaaagagaataagatgtggtctgcaccctctcatgcaccagtggcttcttgagcagtatgatagagagagacagctgagatttagtggaaaaacacaaggcttagaattgggagagctgggttcaagccccagctttgccactaaatggctgtgtagtcttgaacaagtcacctgccctctctgagctataatttgaaatagacttagcttaagcaacaggaaagcagtaatgagctagaggaaggatagaaattgggaagaagtataaatctgcttaggagatggcaagtttggggctgaggtggaattgatctgagggagagacctggtagaaagagctaggcagtatgaggctgagtgtctgaaggggtagcaggcctgggggtggtccagtgatggttgaatgggtgggccagcccagcgaggggatcgcctgcaatccagtagagatgccctcattttcatggcagggtccccctgtgccagtagacagacccaggcctgggaaggagggctggttgaagtgagatggataccagtcttggagcatggttggagaatctgtccagggtgatggcatctgttttggattggggccttgaggcacattttcagttctgctccctggaccagcataggagggtggcagacagtacagtgatttgaatacaggattgatcctgccaccttgatttctgcctttatttagcggcaaagacactagatcagaaaagtactggatgtgattgctgtagtctttcatgattgatttaggagctgggagaggcctggctaggagttggaggatccctgggaagatgaagattaggtcttacgtgagcctcagccctctcctctgtaaaatgggagtaatgatggtaattatgctgatgttacctattctgactggagtaaggattaaagtacttgtctggaggaaggcacttcatggttaaaacatgaaaagagaagtgcacagtgtttttattacagggaaacaccaaagagctggaaaggaatgagggctggagagatggagctgccctgaggactctgggaggtcatcctgggggcagaactttgacagttgctgcccgaggtgggacagggatgctgggaagatgtgacgatgtgcataagtgtgtcatgttcaagatggttctaagccctggccaattccatacatgctcttttcctttctcatccatagaggttttggcaaaggcatacttgggagtgttgatatagctgacactgcagcaccctcagtttacaggtgtgagaagagtgaggctcccacagtctcacttggacaggtagtcagggctctgatggagctcctggagtttctaggttctctgtcacttgatagtcagtgctgggagggacctcagggaatcagccaatttcacagatggggagagtgaggcaggttgggaattctggccccagtggagggcaccacatgcccacagggaaatgtctttcccagccccctcctcatgcttctcctcttttctgtctggaagtcctagttctcctcctcacgctgagacccaggtagggtgattgtccatgtttcttcatttatctgttttttttctgttgcccagggactactctaagcaccatgctggttgctgactgttcgcttttgcaagatcttggaatctctgtttgttcacatcacaactcaagaggatacgttctcattctcccaatgtttgtcttctgcccattgcatcaaattgctcttccttgtttggaattaaacttctagcaatcatttacctttatggttctcttaacttcaggtcacactgttgtttagtcaatgtgagaatctttcagatgttctgcactttgcaaaaggatattcacagccaatgtgtgcggcagtgaaggacacttgttgattccttatttattgtctgctgttccagggaccggggactagaggtgaataaagccttgtttgggctgtctaggatgttgtgatcgacacaggaaacagacatgaaagccaaattggcgcagtgggtgaagtattgtaatactggtctctgtttatgatatatggaagaagtttcctagtagcagggtgggtgagagagtccatcatcattgcagattggtgcctctgtggacatgcaggtatattaggccagaggtggggagtgggagagagagggagagagagagcacgacaaagagagagagagagagtgagcaagagagagggagggagagagacagagagagagagagagagagagagagagtgagcaagagagagggagggagagagacagagagagagagagagagagaggttttgagagcattgatatggggtctacatattccccccggcccccattccctattatcatagaagcatgctgccctccaaggcttttgaatttgccaccgtgaagagcatgcatggaatcttcggctgtggccttgcattgccccctgtcttcgcagcggagcttctttatctgacccgtgcatgtgcctctgatgagcagcccttcatcacagctctgcggcctcctcctaggcccccgccttcagctctccagttcatttcccgccttgttcccattgccacctgcgggcttggagggccacctgacattctgtcctttgggtcccctgtgactccagagctccttcccttctggggcgcccacatctgcgacacgcttgtttgcccagtgcattttctacacttagagttcctctcgtgctctcatatttccatttaaagccctctcgagaggtctgtctcctgccagcagcattccttctagtttactagaactccatttctcatcctgccaggaatccagccgtggagtgagcttcagcaagcctctctgcagtctcttgtctgctccaaaactgtggcctctggttgtgagaaatgggcatcctgagtcagtgagagcagtagttagcttgcagcagcttcccctctccccctgagtgagcctttcttcctcttcctcctctttcattcagcctcatcctgccttgggtccatttgacagataatggcaccttgaggccttgtcttttgcatggcatctgtgcctgactggtcagaaattacttgtgaagcaacatagggggttgttggttgggtccacttttaggatgaagtcagaagggatcgtgagtgatgcttggccaataagaatgtattgatttgatttactaattaatttcatttccagacaccaatatatgcatagccttgtttgaagaaaattaaggagaaccattttgtaaatggcaatgagtgtaagacacttaactatcttcctgctctccctggcgtgggcttccgcgctccctgactctgcttttatttaaggtgtctgggaaggcatttgtccttcggcttcccagctggcttcttgccttctcactcactgcctcccgtagcctgtgggcagaatccctcaccgtgcccaccttgccctgctctcgtctgacctcacctctgtttccaggatttgctatggctgtcccctgccagtcatgctctgtgcttgctactctgagtgtgtccctggtcccactctcttgcagcctctgtgtcttagcacatgctgccctgatggcccaagggcccttcccctttgtttctgtctggggaatgttctgtctcctctttcttgaacctccttatattccctcaagaagacttaaggcaaaaacaaacctgaacttactatgtgtggtatttttgtgttataagtgtaggacctagtcatagtaacacatttcaaaaatatggaaccgtataaagaaaatgagcatcactcataaatcactatttagacacaagcattgtttacgtttctaatattctttctttagtggtgcttttcatgattttatgtgcatttgcattttactgactaaatattactatataaacattttcatatcttgccacttcacctaacaatacagcacaagcagcttctcatggcattaagaattgtttgtacatgtaattttgaatggctgtatgctgtttcatcttaagaatataccataattctaatttttcatcattataaatagcactgtgacgaacatccttcttaacaaaattctttgtctgcacctatgattattttctaaggtagattattagaatttgaaatgccttgcacaaaggacagtaactttttcacccttagtttcagagagaacatgttgtctctggagaaacacagaaacatgaaaaagcacaaagaagaaaataggcctggcacggtggctcatgcctgtaatctcagcacttttggaggccgaggtgggcggatcacgaggtcagggattcgagaccagcctggccaatatggtgaaaccccgtctctactaaaaatacaaaaactagctggacttggtagcgcatgcctgtaatcccagctactcaggaggctgagacaggagaattgcttgaatccgggaggcagaggttgcagtgagctgagattgtatcactgcactccagcctgggtgacaaagtgaaattccgtctcaaaaaaaaaaaaaaaaaagaagaagaaaataaaaaccacctgcagtcatttgcaacagccagtgtgaaatttgctacataattgtatctgtgtatctatctttctaccctacaggttgccaaacattttctgtaaaggactgggtagtaaatattttaggccttgcaggccatacatggtctctgtctcctcctcctcttgtttccgctgctgcttcaagattcttttaactatagaaaaattatttctcgctagtaagctgtataaatatcagttttcccacctggttctagcctcaaaagtggagcaattctgtacatactttgaaagcaatgtttaaaaatttatttaatttaattaattaaaaaattaattggttactttttagagacagggtcactctctgttgctcaggctggagcacagtggcatgagcatagctcactgcagccttggaaatcctgggctcaatcaattcttctgcctcagcctcccaagtagttgggactacaggtgcacgccactgcacctggccatgtacatactgttttgtaattgttctcttccacaatttaactacttcatcagcgtcctcatagttttctgttttaggcaacccagatataattactggctttctgctgggatgcccacagcactttggccagatctctgatatagaatttaaggcacattttattgcgagtatttgctgagatgtctctttcttaagtctaactcctcgtgagtctttccagcctcagcacatttcctgagtggtgcttaatagatgctcagcaaatctgtgtggaacgattgccttaggctgcaagtttatcccttcacaatgcctacatttagattgcaactccaggcttgctccttgggccagcagcatcagtatcacttagcacttgttaccagtggagactctcggtctcaccccagaatctatgtctttaggtgttgctgaaagtttgagaagcattactgtagagctcacctctgctatattcatcatgtacttatttatagtcatccctacctcgttcttttcattggtcggaacttcctgtgactagaccatgggtattccttaattgactgacacaatttgtttcacatacagcaccagctgccatctggcctagtgagacctatgtggctgccattgtttttggctgggagtggttgtgatagatagaggagggagcaaatatttaattagcacctgctatgtgccaagtcctgtgcccagctctttacacacattcttccaagggtgagacatgatggtgtttgctgaagggaacatagggatctttaagtccagtgatttttaaccagctaaagaattgaatatatatatataacatatgcacataatatatatacatatatgtacatatattatatatgtgcatatataatatatgtacatatacaatatatgcacatatataatatatgtacatataatatacatacacacacatgcccagcccttactccagtctagaatcaaaatctctgagaagtagacctggtcaagagtacttagagaaaattccctcagtgtttccattgtacattgctggtgaaaaaccaatggtctaggccagcatcctattgtacagatgagaaaggtgaggcccaaagaggtcaatgagcatcccaaggtcacataaatttaatagcaaggccagacctagattttgtactatctgcctgaggacacacttcacattacctgagctgcttctgacctgcagtgttggggtggaagtagaagtgggtgaagaggttgaactcttgtcctcggatctctgagcttgattgggcagctgggagtgtagaaaacaggcaccacgtcctggagtatcctttccattccccctccacctttgcccaccttccttatgtcctctttggggctatgattgaagaggcttgagacattgaagagcatcaatatctactgctctaagtgacccaggcagctgctgtgacatctggtgtcttcctttatctttgtagagtcatgggcagcacctgtaaaggcaggtgtgaaagaagctttgttctgattcttttttcactgtcccctctgtatcagacactgtcatgggagcccccggtcaacttcttgcttccagttgtgcccagccagcagcaaacagaatgagacatcagctgaagcttttcaaagacatcctgtggaagggcatacagacttcatgtagtggccaagggtgtgattagcactgattacgtggcaaagcggaatagaactaatgaccatgatagctgccatttacccagtgctcactgtgccaggcactctgcttgaatcatttcccgtaatcctgtaacagccatgggagggggtgggagtgggagggggtgtgctggggaggttttatggcctcccataagtggcaagctgggatgtgaacccagttctgcttgattttaaagtccatgaccttaattgtcgtactacactgctttcctagctggatatgtgcttataccttctaacctgccactgctaggaatttaagcaaaaagcccatagagatagactgaactagtgtgtaaggacctatggtagcagatgtcaaaaatggagtggactgtatcaattggtataagatttccagttgctggaggtgttcaggcagggaccacggtacctccttgtgggagactatcaaatggaagatttgactggccatcgcagtgcctctgggattctaattcatcggggcttccaagatatgaatttgtttggaagattctgtcatagagcaataaaatgtactttgggtaaaaatctgtggatagggcattggtgaggctctgaaggatttgattttgcacggactacttccagcaccgagagtcctgctgctggggtttcttagtgcctgccatgtgccctgcactgtttggctctggctgggccccagatgtgagaactttcccacaaggagctccccatccaggagggaagggagagcatgctgtcactgaaagataaactatccagtgccagggagtgtggggagagagacaagtgtgctgcctggggagcttacacgaaggatgcattcaatgaaccaggaaatttgttttttaaatattggatttgaactgggctttgaaggctatatggcattcctttaggttgtaggaaggtggtatcgggtcaccatactgagctgtgtggtgggaaaagcaggtcggaccctaatgtgagccttgagtaataaggaattgaagagtgagcctcctgggcttctttttaaagtgaatagggctccggtaaacttttttttttttttttttttaggatagtagagaaagagcaggggtacattttgtaattcaataagcatttgcattgaggccactgtgactggagcaagctgagcccacctctgttaatgactaagagttagcctgaaggagatgtaggttgggcagggcctaccaggaagggggactggctggtgtaggtaaaggggcagtgcagtgtcagcacctaggtttcgaaaggctccagatgctgagatggtgacagggtcttggacgtaagaagagagagctatgaaacacaggcacaggtacagtgtgaaattttggaaatccctaaaaatgaagccaatgggagtgctgctgtgaactgtgatacgtgtttgcacctggccactggcatatcttctatctctgtttgcagagacgccttctttttatacttcttttgatggtagaggaggaaaggacttgagtcttagagccaaggaggcctggttttgaaattgtcctctgttaatttacagctctgtgacctcgagaatgttgtttctcctccctgagttgcagactcttcatctgtgaaatcggggagcgggcggggtggggggaatattcttaccctgtagggcacaggttgcagggaaggagagaatatccactgagtccagtaaatgcaagtcaggaacattaatcttcttcactcgctcttgttttatccagagtagataactctgttttccccctatataccccacagtttatagagtggataactctcttttccccctatataccccacagtttatagagtggataactctcttttccccctatataccccacagttcatagagtggataattctcttttccctctatataccccacagtttattgcgtggataactctcttttcccctacataccctggctgactttgtgcctttgcccgtgtaatttctaccttccagaaagctactttttcttcacatgtttcaatcatttccatttgtttgggtcaagcctctgcatggttccttggacactctccctaggaatcccaacgggcagcggcttcccttctgtcgttctctcatggtgtgggtaattgttgacctaatgttatgttttgtgtttacacccctctcacctgtcagctgcctgagatcaaagttctgattcatgtctcccctctctgcagcactcagcatgaagcctggcacatagcgggtgcccataaatgggtcttaaatgactgagaaaaagaagcgatcaggctgacaactggcatttccctggctttagaaacctgagagaagaaaagctggtgtaggaaaggagtgtcaggcctgcggcttcctatttcctcattcagggcacaggttgggcttgcccggagccatagttcttgagacttaaccacctcaggcctaaatctgccttctttaattacctcctttccagggaacaggagtccttgttgtctgcccagagctgctaaatatagctccaacccccaggccttggtgtgcttctgggccacagtgctgcacagcctgagatgtctgttgattttggggtttcctcagggattctttacattttcaagttttcataagggactgcttcttattttgaagccagcaaagagacttgaagggcacagagtgttgaaaattttataggaggatgctaggagagagttaaagagcttgggtagagaaggggaaagagaagttcttaaaagagggctaggtggcttaaaaagacgaccttgtcatgcatttaatgatcttcaaaagagtgacatcttgtaatggttttcccaggaaagccccttcacatttgacttttgtgacctcttggtcctgctgttggcagttaatcctttctagcttgaaataatttttttctaagtttttttttttttaatttaaaaggtgctataatacaggcttacagtaaaaataaaataatgcggaagtgtttacaataaaacagtaatttcctgtcccatctcttcccaaaccggttccattacccatagtcaaccacttgtaaccattttttgtttttgagtttttttggtggttactatcatatttctaaataatatgcttctgtctcatgcttgagttactagttttagatatgcctattaaactttattttatgataggtaaggactatttatttatatccaattggtccttcccagttctcttcccaagtcttgacagttacatttctacttttattctttgtggtttcctttatgtttacagaatatgcataaatctcagtcttttgctatatgaacttttgacagtttcgcttcactcactattttgtaagatgaagatattagagtttccctccacttttcctctccacatttacccttcaacttgtcaataatgttttaggttaccttttgcatctcgagggtttataatggatacatgcatataggcacatgtatatattaatggttttatacgtatagctaagtcatctgtgctctgtggtttgattgcaaaagctgaaaaaataaataatatttacattatgatttctaggtaaatattgcttaatacagggctaagtcatgtgctgtggtttcatttccttttctggggttctgaggtcaccacctttaagccacttataggagactgaactttcccttagcatcaaaatctaatagatgattgtaattttttctgtagttgttcagagtcattctacattttgtttattttatttctatagtaaatagataataaataagcttcttattataatttcttcttatttcttaaaattttaggctgtattttgtttttgttgagagaaaaaattagcattttctaccatatctcttatgtattctgtcgttctcttgtctgcttggagtctgttctgtgtgtcttcttcaagttccagcaactttttctcttattttggactggtttctccatatctgggctataatttcttacgcagtttccccctcttccctcccacaaagtttctaattgcttccttttatttaaacccctgtgtttttattatggtttcagatatttccaggctttcatggaggcattcttctggagctcctgagtaatgtcattatctgttagtcatcattattaatattcagaagcagatatgttattaaaatattattcaccaattttttaataccaggcagttttgtttgctctttcttttttttctctactgaatattcatagacattctagtttattttttaattcctatatatttaatagccactctcctagtccactgagtggatgtactatttttaaaatttagccatttacatattgttgaatgggagttattgccagttatttgctcttataaataatactcttttgaacatttttatgcataaagccttttcattaaattattttatatgaattcttcataggggaagaaaactggaaagcctgtgtcatcatctttgaggacatatgccagttgactacaatggtgctaggttttagtggggatcacttggcatttcttacttaagatcctcttttttccttttggaaaggagcagtaagaattgggaggggagtaccacctctgaatcagcacatttagttttcttggcagcttttggaagatataatgtattgggacttattgcaaagttggtactgcctagtaattcactgagttatcaccctccttaaaggagtccccaggggtcagccaacactccatgacttaggcccatgatgctcttgtcacctaaaatctttgtataacaattatttggcgaagtgttattcagcatgatcatctccaactggatcatcacccttattcactggaattgtttctcggtgactttgggaaaaaccagattcattcttaaaactcaaagaggaattcccattgagaatatgctacaagatctacaactgcttctacacgtggtatataaggaagggtttgaggaatggcaggttgttagaatgaatggactgctgggaagaaatacatagtgatgggaagcatggtaattgatgtattgaagatgctgcatcattgttggtcaccctgcaccatggtattactataaaacttcatcaggctagcaacatttactctatggttatggatgaaatctgcatcacataattacacaaaaataggatccttgtctttgaaaagcttaacaattcatagatgaacactgatcatactaaaagaatatgtacctgttgccctatggaaaagacctaagcttaatgactcacagtctaattattttggttagtgggtgataatgtattggaggtgatgatgagacacatacatccaaaatctcacagcttggagaggatgtggtccaacagtgctattttatttatttatttatttgagacagggtcccactctgtcacccaggctggaatgcactggcatgactgaggctcactgaagcctcaaccacctcaggctcagtttgtcttcccacctcagcttcctgagtagctgagactacaagcatgtgccatcatgcccagctaagttttgtattttttaatagtgacagggtttcaccatgtttcccaggctggtctcaaactcctgagctcaagtgagcctcctaccttggcctcccaaagcactggcattacaggcatgagccaccgcactaggcccataaggaagagtttctgagatgtgcgagagtgataggcaggccagggccctctctcaggatataattggggccacgctgtggtttctgatatttgaggaatttggaattctgatttatttttgcctaagacacctcattctctggaatacaaattccacatctataaaatgatagggttgtatctgatggcctgggctttgtaaacccttctgttctgagttccataactctgtgattctgggttctgtcccaagtccaagatgatttgaaaagaataaaaaaaaaagaccttgctgaatcagtaccagcgtcacctgcttcagtctggctgggaagtaggtcagaacttggcagacacgagaatgtggttggctccaactgtgagctctgccagggtcctttgtagacacctgccttagaaagggtctgtgaaagaggggggtgctgacactcggaggtggggaagggtttatttttggctgtagatgctgcaagcgaagaggggtgattgatgagaggaggtattgggggacagggaatgaaagactgaaagaaggagaggagcaggcacgtattgggtgcataacttgtgtggagaaatggccaatattttttttactcctcccacacacactgtaacgtaggtggtaggtgtcattctgtggattttttttttttttttttgagatgaagtttcgctctgtcacccaggctggagtgcagtggcatgatcttgactcactgtaacctctgcctcctgggttcaagcaattctccctgcctcagcatcccgagtagctgggattataggcatgggccaccatgcctggctaagttttgtatttttttagtagagacggggtttcaccgtgttggtcaggctggtcttgaactcctgacctcatgtgatccgcccgcctcggcctcccaaagtgctgggattacaggcctgagccaccgtgcctggcccattctttggattttaattatgaggagattgaggcttggagatgtttaggtacctgtccagctaggctgctggtaagtgagggagaaggagtcaatgtggggtctgactccatgtcgcctcttcctttcacgctctaactgtgccatgctctgttctaggcactggggatatagtgatgaaggaggcaggcaaagtccatggtctcataagtgcttgcattctaggaggcaagacagacaacaaagtaaacaggtgcatatttcagagggtgacaagcgctaagcagcagagtatgacagcagtagaaggcaggagtgacagagttgcatgttgtgtttttacatcctagtccataagattgtgcactgagatgagctgatctgaggaaaccaacagctctagagtaagattcttgaggttagaatttagccccggccataatgtgaaccaactgtgaaagttgagcaagtcacctccccatcattgttaaaatgaaggaaaataatccctgttcttcttatttcactagatgatgaaagaagatgaagtgaataagtttgatgtgccaccatttttaaaactctggttggggccaggcgtggtggctcacgcctgtaatcccagcactttggggggccgaggcaggtggatcacgaggtcagagattcgagaccagcctggccaacatggtgaatccccatctctactaaaaatacaaaaattagctgggagtggtattgcatgcctgtaatcccagccacttgagaggctgagatgtgagaatcacttgaacccaggaggccaaggttgcagtgagctgagatcgtgccactgcactctagcctgggcgacagagcaagactttgtctcaaaacagaaacaaaaacaaacaaaaaacccagttggttttaaaaatacaaggagctgtttttaacagtttggttaacttttaaaggataccttcttatatttatttgctacgctttgtgtgcttggaggaaacaactgtttctttggttatttccttattcttagaatgaagacctcctttgccatcttcagaagagtttggatttgatttgtgggcatcagaggaccattaaaggtgtggagccaagagctggcctttaggttttgccactggaagtgggtgaggatggaatggaggggcagcagccagtggtcagagagatggcttgggtaactgtggaaactggaatcaaattcagtctgaccccacagtttgattcaacacagcagtcaggtcagccagtgagcaaacactcactgaaggtccactgtgagccaggtggtggctgaggaggggaggcataggagacattgaatcaactcagccgttgctacgagctcactgtagctgagtgttctggatgctggggagtcatgtgcttccggacctcaaggagcatcttttccagcagttaatatctgttctgttcccaaaagcatataaatcaatgttgattttagtaggcaagttatccatgcagacagagagacgatatttaaatatgtataacactgtattgaaataactctaggtctgccagaggggaactttagttgctggatcttgaggaggtttgagggttcctagggggggattgggaaaattgggatggtgttaggacaactaggagcctcaaaacataaactatttggcaatgagtaagggaatatttaaatattttagcaacctgtgttgctatatctctgtgtactgatgaatgtcagtttctcatgtggttataccactatcttatagcatcctcaatgtagtacttgatgtgcacacaaggcacagaggaggtagcgattagaaaggcttcatggggttggtgatgcttgagttgggttttgtaagatgaataggagtttggtaaagaactttctaggaagaagagagatcatgggcaagaacaccagtgtgtgaaacagcacaggacttgactggacagttgaggggttcaggtctaagggattttgtgctcaggtaattgtgagcacagtcgtcctgttaacagcagggaagaaaggagaaagagcagcacatccatttaatctctcccacagggtaggggaaatatcaagatgagaccatttttatttttattttaaataatagctatcacatgccaggtgttaggcagttagcaaacattgtttctaatctgacagtaactccatgaagtaggaattttcattcttcactcattctacaggttaagaaatcaactcagcatatttaagtgacttgcacaaagtcacacaatggcaagaacagggtttgatctcagtctcatctgactacaaagtctgaacgttccgcttttccactgtatggcctctctctcctgggaatttgcagtgagtgacatccatgagaaacagggcccttttcttgcctagaaatgtaagttgtgacaaaaactggaggtgtccgtatcctgttctgcaaaacgaggacaagagttcttgctccaggcgtcggcagtgctccggaaagacgaggcctcagatgtactgctttccaataccttcagcaagaccattctcagggagatgtttctctccatctttccttgctgcccctgagactttgacttgactttttactcctgtgaaacaacctcctgatggtgatagaaagaataggctgaccacatggacattttgtgtttatgctgttgtgacagggctttcttagagtaaatcaataacatgttcctggttgagatttggcctgtcctataacttgactttagggagagaatgtgctgattatgctgaagatagcgtgttggtttgtgtgtctttcatgtttattactgtacaagaagaagttggcgttctggtacctcccctccctcaaccattacaacaaggaaaacaaaatccactgagaggcagcatagcatggcgatgaagaacatggactgtgagctagattgcctagattcagttcccagctctgtcgctgtctagatctgtgtctgtgtctcggtttccttacctgtaaaacgggaatgatgataattgtagctactgtacaaggttattggaaaggttaaatgagttcatatttctaaagtatgtaaaaaattgcctggcatacaacaagtgccatgtaagtgtttgttaagtgaggacaacaacaaaattttataaacttgccctgctttccactgttccttacaggacatgatatttgcacaagtctgacctctgttgtgtgtggtcaggcactgaagggtgacatgttcacatgtgtggtctggtggacactagttttgatgactgctttgccataagaacttcgctggctatgggaaaatgtgtggttgagaaatagcaagtagaaggttctttttttttttctgctagtaggatagagtttgggttaaatggcatttgcagctgagtttatccatttttaaatttttcctggagttacactgtgcagcctatgcatcaatggttttatctggctcgattagtcagtggatagtttttaatttgacttaaaaaattgggggtcacataaagggaaccagcaaaagatttggattctgatgaacaaggtttaaggctcagctctgccactgacatgctgtgttacatgggcaagtccccactcaccatctttggtcctttatgtactcttctggttctcattgtttcttccctgaaaaaatcagggtgctgaatggtcaggtgagctccctattctctgttggtgagtggccctcattcctggtcagttagccatgggctattgagggaagatgttttatgaagtgtattgatggtaaatttagacagcaaaagaatccaattgatcatcttaattttttcctctgtacttcgtaattgtgccgataagaagtcctcatttcagctttacaccttttctaatttcccagatatttctgtgtatcaccagaaggcagaatggatccaaatagttattaccactcagctcttagaagttgtttgggctggagaaatgttttcattattaggacactttctgggtcctctctctagagaggcaactgagcctcaaccataccatctcccaggctcactccgtcctgcccaatctgtttacatctctactttggaggcaagctctatccagttctactaacctcagtgcgatgactcagggaaaacctagtttctttttcctaggaaaatcaggttgaccacaacttctgtagttcttgagggaagaagggaagtataatgatgttggaagtcaaaatattgacattaagatagccaagtggagttttattatgtatgtatgcatgtagacatgattgaaatgtatattacaagctcatatgacatacctttataatagagaggtacctgtggattctaccttacttttgttagtgttttcactgtttcatgtgagttttacaatgaacctgtgagatttgcagagttaagagttatatacccgtctatggtagaaaacacaggttcattcagaggagtaaagtggcttgcttgagatctgtgtcagtggtagtcttctgactagtgtttcacagagttgttttgacctaagaaagttagagcctgggccagacgcggtggctcacgcctgtaatcccagcactttgggaggccgaggtgggcagatcacctgagatcaggagttcaagaccagcctggccaacatggtgaaacctcgtctctactaaaagtacaaaaattagctgggcgtcgtggcttgtggctataatcccagctactcaggaggcttaggcaggagaattgcttgaacctgggaggtggaggttgcaataagctgagattgcgccattgcactccagcctgggcgacaagagcgagactctgtcaaaaaaaaaaagaaagaaaaaagaaagaggctgacgaaatttgtgatttttgaagcaacagaggaaatttagaaagaatgaaacttacgccgttaatattaagttataccaaggatctactcataatataacccaagactagaaacttaaagtactgtatagttgataaagagaacgaagccgtagagagtttactgaatttctcaatgaagtggcaagcatctatccatccttccattcattttgtcatattattagaaaaaaatacacagcatgccagctgccatgttgagccttgattcatcaaagttaaattagaatgacatatggcagtttagcatttaaaatgtggctagttcgaactgagatgtgccgttaagtataacacaccagatttcaaaggcttagtataaaaagtaatgtaaaatatcttattaataaattatatgatgttcattacttcttggaatgataatattttggatatattgggttaaattaaaatgcatttctcctatgatttcctgctttttaaaaatgtggctgcaggaaattaacaatttcatatgtggcttgcatcttattccttttggacagcactattctagcttgtgtctagtagaggaagtaagatttatacggacatgcttttctgagagcgtggcatctcgcttctttactcctctgcctttatatttgtctctactgcctcaccttcttttggcttcttaacccattctggtcggatggaagttgttcttgtccgggtctagagggctcagatgcattcctttttagcagtgctcttatttggcattggtggtgctgtttctgttgaccactcccagtgtctctggatgttttgttattcctttacctccctagcctctccttggggtttctttgcaggctcttgctctctcttgtatcccataaatacaagcattgcagagctttgtctcatgactgctaggtgtttatctccagtttggaactcctgaacttcaggcccacactcctacatgccttttggacactccagttggaaatcccaaagttgcatggggctcaccgtgtcttttggcattgttagcttggtgagtgacatcgcccaatcctggaaactgggactcattccggatggctcctctctgtccttcactcttgcctctgactgtcctcagtcttacagagtcaaccacggtaacacgtcctgcccacttccctcctccctctacctttggagcctgtcctccattcaggccctcagcatctctctcctggagtgcttcagcagtctcagctggccttctttttctattcttaccctcatccatcctattctctcttttcttcctgagtgatattccaaaaatgcaaatctgttcatgctatgtccctgtttttaaaatccttcaatgctttcctcattcagggcaaattaagaatcctttgcatgaattaagggacaggaatggaaagaggcaggaagtggtttgacccctgcctctttctgtcctcatctcactaatctccaagatgatcttgtgctctaggaatatacctgggattctctgtagctcccgtgacctcacacatagtgttcccttgtctgaaacaccattgcccactctatcagtcctttcaagattttgctctgataccacctctgcctggaatactcctctgactgttattgtctctgcttcctccattttaggccatttgttgaactgggctgcatttccttgagagcaatggtaattctttatatttctgtatcttcaaatcaaaaataggtgtgcaagtgatatttgttgagcaaataaatgccaaataataaattgtatagataagacattgtgggagttgagataaaaattctagccaggtagggatgggagcatggagggttcaaggaatggtgacatttaagattggccttcaatttgggtagtattgggtgggacagtgcagaggagacccctatagtcatggttattgtgccatgttctgcaggactgaaggatattgaataggcccattccctgctcaataccatcaccaccagagtagaataaggatggtaatctcaggagtccctttgggctagtgtctatcattttctcctgagctgggttatataactcggcagagctttattgccccagtacacagctggcatggcaggcaggcactccgatccttgcttgtgagctgccttggaggaagcgagtgcagaatggttgcctgcgttttcatctttacttctccttcacagccgcctttctgtatagcatagaggtgacctcagcaccagagacaggaaagaacacaatgagtcatctcaggccctaatgaggtgcataagggaccctacttaagagtgagggtcaggtgaggtcatgctatgcctggggtgagttttgcctcggggctccaggcggcactggagcagagctgagctaattttacccacaggagctgactgtgctgaagggcagggcttatgacattggccttatcatcctgtgatacccagaaagctcccaaggtgcaaccccgttatgtctgggctgttttcccctcttctagttaaatacatttttccattaggcgtgcatatcgaaaagcaggatgctgaggtgcaaagagctttggatttgggtggaaggccacggagttggatttggatctcgcccctacctttgaccttgcacaagttacataattcgagtctcagtttcctcatttgtaaaacctcattcgtatacctgtgtcctaagattgcttctaggtttacacacttggtgaaacgtagcaagcgattgctatgtgccagtcactgttctagctgctttattcatattgtttcacttaatcctctaaagaaacctatgaggatggtgttattgttatccctgtttataaatagggaaacaaatgcacaaggagcttagataagttgccccaggccaccagccagtgacagagctgaattcaggccagtggctccaggcaccacactcctaaacaatataccttattgttttgaaatgatagaaactttccttgctatatagcacaggcttaatgttttctaactacctgctgtgtataagggcctgggcttgatgctgggtaagagagcagcatagctgttgtgctgttctgtagacttgaatcacatttgtagatggaagcccttggtcagctgaagggtatggtggatagactttggtatctgacattgtaggcactgggtggagtgctcctcacacgacctctcatctcatcctcataacttcttcaatagtcaggcattggcatgcccattttacagatgaggtaatagagaggtagcatcacctcctcacatttacttggtagacagagcgactggggctgttgggtcccatgtttatgttgattcatttgcattccccatgaactgtgcagtgtctcagagctattattgttgcagaactcacccctgcccttctgcccaccactgacaaccctagagaaactggtgtccatgaaaaacgtgggtcaccagatgagaaagtcacatctgcatggtcagagcaggcaccaggtgaaggtaaaagaaagggctgggctttgttccaattgtttattactgtgtagcaaattacccccaaactcagtggtatacaacaatcgtttagtatgctcatggattatgtggatcaggaacttggacagagcaaagggggaatgacgcttctgtgctccacaatgcctgggatctcagctggaagactcgaaggctgggtgctagagggatatggttgctcactcactcacatgacatctgagacgttaaccaggcctgttggtcagaatatctacatgtggtctttccatgtggcctggacttcctcacagcctggtggctgcttccaaagggcaagccttgagaggaagggagagagggagaaagagagcgagtgagcattagcaggtgcaggaagaagctgtagatgcatcatctcgctatactttattggtcggagtagtccccaactcgcttagattcaaggggagaggcaatagactttacatcttggtggggtggccaagttctggaagagcatgtgggacggaaaatttgctggagcctttgttggaaaatacaacggaggctccttttggccaaaaaggaggaacagacgtctctgtggagctgcacggaggtagagccacagggtatgcagcaggcgcacctgtatggtgctgagtattcactggcaaatcaggaaaacaaaggtcaagccaggaatcctaaggaaaggatcagtagttacgctataaccatgcttcattgtatatgaattagcgtttatattgtccataaactagtttgtgtaactctgatttgctgattacatcgactgcttatgtaaccctggagttctaggtctattttggatttttttttttttctgtgagatggggttttcctgttgcctacctaggctggagttcaatggcgtgatcttggctcactgcaacctccccctcccaggttcaagacattctcctgcctcagcctcccgagtagctgggactataggtgcacaccaccatgcccagctaacttttgtatttttagtagagacggggtttcaccatgttggccaggctggtctcgaactcctgacctcaggtgatcctcccaaagtgctgggattacagccttgagccaccgcgcctggccctatttggcttcttatactaaactgagatattttttgttccttcacagaggcaagggagaagcttttagatatagacagacataggtctcagccaaataaataaagaatgagtgatcggttaatttatctatttttttttccctcctgcatctaacaaagttcaggaaagacattctgtataatttaacaggaaagagatgctaacaaagttattgaaaagactggagctactgggtttaagaatttttttttttttttttttctgagacggagtttcactcttgttgcccaggctggagtgcagtggtgcgatcgcggctcaccgcaacctctgcctcccaggttcaagagattctcctgtctcagcctcccgagtaactgtgattacaggcacatgccaccatgccccactaatttttgtatttttagtggagacggggtttcatcatattggtcaggctggttagccacaatccagggataaggaagatgtgattaggaagccactgctgaggcctcagaaacttttctcaacatcttaatagttagtgatggggcactggattggcctatggagtgtccttttgcccttcatgattccctggtattgcttgccagtagaaatagtagcaggaagattcagcttcacttccaccttccagatcacacacaaggaaatcttactggcggaacctaatttactagctttgaggaagtatggggaatgtaatttttaagtcggcttctgtgatgcagaaaggcactctagctggtggaaatagtctgattgagccagccaagagaatatatctacccccaacttatccatttaaaatccccaggagttattattctgaaatacttaatgtttataagtaattataacactgtaatataattacactatgaaattatgtttaatatttgtttatttatgtaaaatatataaacttaatataattaataccctgaaaaaacaggccagttgcccacgttcagtttctgaactgagttcttatttttgacgacagcagttgatttgcaattttccagttcagtttaatctcctcctgggagtcataccctaggacagttgtcttgtttacaaaatttcttcacaaacatttattaaacacttactatggacctgtccctgagctggatttggcaatgtggggagagagaagtcaaggattcttccactgggagccaatactgggaaggagaataaatcaggcacacagttagaacagggcaaggaagatgttgatcaatgccctacacagcaggctcagcaaatccagggaagagagattattctgactgggctgagaagtagagagttttatatagtctgtgatccggtgattctcttttgggggtagtaccatctcattatggggcatttaaaaatgtgacggatgccaggcgtggtggctcatgcctgtaatcccagcactctgggcggctaaggcgggcggatcacttgaggtcaggagttcgagaccagcctggccaacgtggcaaaaccccatctctactaaaaatacaaaaattagccaggagtggtggcgcatgcctgtaatcccagctatttgggaggctgaggcaggagagtggcctgaacccaagaagtggaagttgcagtgaggtgagatcataccactgcactccagcctgggtgacagagtgagattccatctcaataagacaaaatagcagcataatggggtgtcttctgttgtcccaacgactggagatcaggctgccattggcatttagtggttggggccagggaagttagacgtcctttaatacatgaagacaccacagataaaaaactgtctttctccaaagggtcatctcattcctgttgaagactacgagtgtgcttgatgatgtgtaggacgtggatatttggtgttgggagtggaaggatagcaggtcaagcagaggggacaaggtgagccaagagtttagtttaaataaagcaaagaatatgtgttgagtggcaatgggagaaagtttatggtggcaatagaagcttcggtcccggttgtggagaaactagagctactagataaagcacttggacttcccctgttgccattgggaagccatttcagatattggagcaggtccttgagagcagaaacgtagcctcgtcttggcaccatgcatcatgtaaacatcagtaatgctttttgaatgaatgaatgcctcaaactgtagtttacaggtgttagactagtgggtacctgagttttgccagatttaggatcctgtggttctgggagggccctggcagccagcatttggacttttagagaatacatggaaagggcacagtggcgtgccacacagatactgtctccacattgtggtcaggcagcagcagtacttgctgacaccgaagagagatgtgaaaaagagagattcttgcatggactcctgtgtgaggcccataagccatgaggcatgtagggagcagactgtgtcgtctgcatcaatgctcttgcatcttgagcttttaaaaaattgccattcaaaccagcaatttgctgacaaggttcacgcgctatgaccatgactgcagttgatcctggggagtggcttgcttgtctgcctggggatggcagccgcgtgcgttccctgtgctgtcctgtagggttgtggtggctttctgatattcaggttggtcccttttccttctttttggatgggctttcgaggttgggagaggaagctcagggatggaactgactaaacatatgtgagatgtttccttgtttgctgctcatggaggtttcatttctgaagtcttttcttgggagggaaaaggatgtgtggatatatgaggtgactctagaaccctcattttatggatgaagaaactgtgattcacagagggagagtgatttgtccagtgtcacgtggggagctggccggggagccagacctcctgtaccttttattgcagggtttattttatatatatttgctggcaaaaagaaggaaagagaaacaatttatatgttttttatttataataaaaatatttattataattatataataattaaattatagtaaaaatatttatttataatataaatataaaatgtatattatattataattatatataattatattgtaattaaattatatataattttatatattatatattatatatattaaattataatacagcatattgtaatacaatatattttatattaatatagtatagtaaaatatataatatataatataatttcattataataaaatataataaaaatatttaaaaatgtattttatatttacatatatatttaaatatatacatatatttatataaatatatattaatatttatatattaatatatatttttataaatatatatataatataaatataaatatatatttatataaatatatataaatatatatatttttaaatatatatatatttttaaatatatataaatatatatatttaaatatatataaatatatatttaaatatatatatatttttaaatatatataaatatatatttaaatatatatatatttaaatatatataaatatatatttaaatatatatacatatcaaatatgtatatatattttttctcttttttgtagagagaagatctcgctatgttgcccaggctggtctcaaactcctaggctcaagcaatccttctgccttggcctcccaaagtgctgggattacaggcatgagcccctggccttatagcagggtttaaattacacccactttgggggaagagagagtggtgtgtgcaggctttggtgccaaaggcttgcacatggttactggctcagccacttactataaaatttgtaaaataggcaccatggacacatctgatattaagcatttaaaaagaggagctgtgtgaaaagttttgttgactacaaagagctacagacatcttcctttttatcttgatgtggatgtttatgcactgggaattggtggggccatctttagagaaggggtgggccagtgaagacactactgaccataccccaatcagaaaacactcccaaggggctcacttccccactgtgcagtaaagaggttttgcactgagatttggaggtacagcacaaggcggggaaagcatgagccaagttttgagtcctgtggaattgagggtgcactcctgcctggggccaggggttcttgtagcaatataaagggagacgtggctaaaaacatagattgggctcatcctggaggccttgagtctggcctgagggtgagtggatgctatcgtttgtgttgtttagagcactggtgaggagtcaactgggaaaatctcaatgaaatgcatctttaggatgtgccgggaatcttggcagtaactcaggagggcaacagggaatcttgcaattggagtagcggggggtgattctcaagttttggacacattctaagtaactttttgcagtgcttcaactttttacttgagtttataataacaatggcaatattttttatagttgtagagctatatgaaatatttttacacctgttggcttcattgttcatacaatatcttagtgagggggaaggtaggattgttttcgttcctgttttacagacaaggaaattgaggctcagagagcagatgggatttctctggccgcttggctggttgatgtggaagtcaggagtgaggatgccaagtttcacacttcttcctgtgccaatgacctggaggagtgtttttctcaaactcacatttctttatcctccacagtcttgggtgtcactcttggaagtgtaagatggtcatgagtttcaaagatttctgagataagctgttaagattttcaaagatgagctatagagaatttgggacataaaatgtgtttcttccagtaactcttgcttgctatcatgttgttggttcaaattgaacatgttgataagtgccagggaggaaagaaaccagtacctgctacttattgggcaccttttttgccctgaactcagtactgcctgcttttccatttgagtatctagaaacatttatggatggagtgattgtaatattgtacaattctgtcaactagtttattagctaattctcataaaagccttaggaggtagataaacaatattattttccattttacagatgagaaaactgaggtttagagagatgaaataacttgcttataacttgcttgagagaacacaggtcctaaatagattataatctttttttttttttttttttttttggcagagtcttgctctgtcatccaggctggagtgcaatggtgcaatcttggctcactgcaacctccgccccaccaggttcaagcgattctcctgcttcagcctcccaagtagctgggattacaggtgcacaccaccacacccagctaatttttgtatttttagtagagacggggtttcaccgtgttggccaggctggtcttgaactcctgacctcaagtgatctgcctgcctcggcctcccaaagtgctgggattacaggcctgagccactgcacccagctgtaagtagagtataatgtaagttttctaatttgagacttctttcttccttgctgcaccccatctacgccatgtgttgcccatcccactggtgaaaatgcagagctgcttgttaaggaggtacatgtcagaccttggaatttactggaatcagacctggaaggtactatgaagagctcagaaggctggtggttttcaagctgttctcttctgagcctgagagactccaggagtcatcttgagggatatagcacggagggaggtgaaaagtggtgggaagtggaggaaggaaggggaccgctagagccaacctgagtcgctctgctttttcctattttgtaagctaaacattgtcaaagcatccatttaaaggaaaagttctgctgctacatataaaagttaaaaaaccactgtgtctacccttccttttgctaacactgagaggcagagtggttcagcacaaggggacacaaagtggcttagcacgagtcacgagatgtgacgggtctgagacctctcagcctagagctcccttacccctgggccactttgttagacacacctcctttaattcaaatccccgtctcagtgggacatggctttttcattttttcaaggaaaggtttaatctgtccagatccctgtgaagatcttggctcttggcgcacctgctggaggttcgaggtcctgcaaccacagagtagctgcaggaccttcaggatgtcccgagccacaaggtctttgacctgcattttgcaacctggttgtgtctcccctttggactctgggaaccttgctgagattggtacaatatctgtgctaaaaaggtttgaaattatagctagtattgtgttaccttcctggtccaaccttcacagacattgtctgactaagtatatataactcttgagtgttcactgtgtacaccggctcacaagaaaggcaaggttcctgatcccaaggatctaatggagagacagaaacaaatataaacttttgtcaactatttcagagacagttatttttgttatacaagattgttatgcatgctagttatgtggagaggatttcatctcttagaaatgagacggggagaatctgggcgatgagaaagaagaccagaactggggagtacagtctagaattgcaaggggttgagtttgctatgtgaagcagttagttttggactgttgcacttactatttctgagatttgagcatctgacttttcctttaagcttttgttttctcatttgtaatatgggagtgagagtgcctagttcacagggtcattgctggggttaaatgagataatgtatgtaacctgcttagtataatacctagcacagagtaaacactcattaaattttcattgttatcgttgttatgatttggcagcgaggagtcaaaagagcctattttcttaaactcatcaatggtataatcagagctttgcatctcgaagtaaaggaacactctgcttttattatttatttatttttcactctgcttttagacatagaattcaattgcctcaggctacaacaaactggcttcaatctacctttctgagttaacttctgtttatttctatccatctgcccacttctctcactagtgacctacacattttcttttttttttttttcttttcttttttttttttttcttgaggtggactcttgccctgttgtccaggcttgagtgcagtggcataatcttagctgactgcaacctcttcctgccgggttcgagccattctcctgcctcagccccctgaatagctgggattacaggcacacaccaccacgcctgtttagtttttgtatttttagtagagatggggtttcaccaggttggccatgctggtcttgaactcctgacctcaggtgatccgcctgcctcggcctcccaaagtgctgggattacaggtgtgagccaccgtgctccacccacattttctaagcttgattttaacttgctggtctttgtcatatcttctcagtcattgctggggttcaaatctttcttttctttttcttcttttttttttttttttttaaagatgggaatctcactatgtttcccaggctggtcttgaactcctgggctcaagtaatactgccttggcctcctgagtagctgggaccatagacatatgccactgtgtctggcttaaatatttccttctgtcggaatgccctttgttccttcatctgtgcccccctgctccatcctcttttaattcctagcccaaaagtctaacccacccattgggagggattctgcagaactcatagagtttacaacatcttgtccttcaattgcagtcagtctctgtcttgaactggatttgtgagctccttgaagttgtttgtatctcacagctctttgctgtaacatccctggggattcaagcacgcacacatagtagatgctcacacatctatgcaataaattactttagtgtctttctcaaatgatcagcacaggaagcaaatgataaaatgcaaaccagaaaacagacctcactgggctctgtgcttgtcagccttgggaatggatttctggcgaagatccggcccctctacaaatgacagagatgacttggctcttttcaggaattgaagagaatcctgacaagtggcatgttgggaaaggcctgaaggaagccagaccagcttgctctcagagctccttgggtcccctgcggcccccaggtgatcttcagcaagacctggtatgtaaatgagcctcatctgctggctcagcctgctgcccactgctagggatgctagaattccagggtaagcttctgtgagccgggctgggaggtttagtgggttggagattactagctttttggtatctgcagcttgaaataccttgtgcccttgattaattcatgcttgggagcatcctcagtgctctctggaaaatagctccttactgtatgtttatttccccacgggcttatttcagagagactggagcctgtgtttctaacagcttctccaaggaaaacatcgcaggccacgtttccggaactgagaatctcagggggtctttgaaacgtccatctctattacctccttttggcccagcatttgcttttagctgaaaagggagattttgtcttgagccttcctgtagacatatgtgacttggagtttgaaaatctgacagctgctgctgagctttgaactgcaagagtgagcagcatatagacataaccccgtagaacatcaaatcattttcctttaattcccagagacttaatgtttctttgtcttgcgaatgacctcactgctttttgtatttgtaatggaatgcacagtcatttgtaagtaatcacacaataatcccttacacttttataatgccttacccttttccatagggctttcactctcattatctcatatgatccttataactgctctgagatataagcagagcgcctattttaatctccaattttcaggtgtagaaactgaggttcagaataaagttagccagagttaaaacagttagtatgtagcagaattggaaagggagtctacagaattggaactggagtctcctaaaccagtgtttcttttgctccttattgctggtgtgaccttgggaatatacttaacctctctgaacctcagtcttcctatcactaaattgggtataatactacctcctgggatagttgttggaagggattcaatgagactgggaaatcatttaataaaaggtagaacacactaataatgggaggcatcattgtacttactacatgggccttgacggcgaacagtgccatcagaactgtgaaagaaaataacattttttctctctttttagaaagacacaggttcagaatggtgttgtcagggatcacaagctcccagccccgtgattagcaaattgaccctgctgccctgtctgctggctgctttcttattctgagaattgtgttgacaagaccctcttttcctacagagctctctcttaatgttgcttggaatagccttgtgtcctggagacagttttaggtctggcaggatctgagaacaggagtggggatcttggaatgggatctgcatccctgagcttcatccacaaagggtgggaatgtggcttgggctgtggggtggaggtagatgaacagctggacttgcaggtctatcttctgttgtttctcaataaagtagacaagtccatctgatgggtgtttagtagggtatgacttgtgagtccacaaggccagcagtatatatgctgaatggactgcttagcagtaacacactggaaaaatccaaaaagaatggatttcaagttggcaaaaaatgcattagaagtcagcagtgtgatgtggtcaggagaacaaccagagtgactgtgggatgaggtcttggatagctttgtttctatatacagtcagccctctgtatccatggtttctgcatccatggattcaaccaaccaaggctcgaaaatattaaaaaaaaaaaaaatccaaccataaaaaaatacaaataaaaaaaccaatataatataacaactgttcacatagcatttgcattctcaggtattataagtaatctagagatgctttaaagtatacaggagatactacctcattttatataaaagacttgagcatctctggatttcggtatctcaggggtcctggaaccaattccccatggatactgagggaacgagtgtacatactcacctacaaaaattccaaaccagtgagacagacataggttgaaatatggtcctgagaggcagaacgtgaagcaagggatggaaggccggggaggaaccagatttcagttccgtgtaaggaagaactttctgatggaaagatggaatttgcagtggcaggagataatgatctttgcttcactggagacctcaggaataccaatggggcaggcactgggcttaatggcctttatggccacttctaattttgagatcacagagctaggaggatgagaggcacacatatattgaaggaactgaagggtctctctctatgtggatgtggaaactgatctccaaatgtttgcaagatggagggtacgtttaaaatatttcattctggttttcatattgatctctgtggctctccccttggtctttggtttttaaagcttaagaccattcccagaagctcttttccatggaataatctcctttctttgctggaatgctcctgttgggatgcaggaagggactctgagctcctgacagaatgaagaccacccctttttgctctccagacctaattttgacgtcccacgcccacccgctgaggagggttgcaatggcgagatctctgtcctgaattctggttctggcatgcagtggaaggccctctgattctgtttccttacctattttaatagtaacttatatttgtgttccttcattaaatgtacaataaataataaatgtttgcttacggcatgcttgttaagtataaaacaaataatcaaaatgaatgtgtaatgaccctttggatagaccaagtagaagctgcttttaggacacatgattggaccatttctagatatctgcctaatttgtaaatgaaaaatatgtaagctacacaaggagcactgactcgtctaaaatcttaacgactgactgatttgggcttggggtttggggcttgggtccttcatgccctgatcagagctgtttatagcttgaagacttcctgggggtgagaacaagcaacctcttggtgcagtccaaagccaggaaatgggtgacgattttgaaaaaggactcatctgacctccagaaagcctttacaaccaacagtagaacgagatcactaagaaacagaaccaccgggaagccaagatgtggtacttggattcccatctcggagcacctcctatatcccgacacaccatttcccctagtgtctgatctctctttctcctcctttaattcagtctggagtcattttagatcagattcattcctgattggcttcactgctccaacttagtcatcacagaaccttagggttggaatccatgttacaagttaaactgagcaattcacccccacttttcctgacaacagtgttctcttgagagtctggttttattctgagtcttccagcccggtgtctgtgcccatgaaggactcatgccaaattacattctcaggaggactcccagaccaagagactctgggcttgggcgtgagagacttggggctgttctttttctttttttttttttgagaagaagtttcactcttattgcccaggctgacatggagtttcactcttattgcccaggctggagtgcaatggcacagtcatggctcactgcaacctccgcctcccgggttcaagtgatactcctgcctcagcctcccaagtagctgggattacaggcacacaccaccatgcctggctaatttttgtatttttagtagagaccagttttcaccatgttggccaggctggtcttgaactcctgacctcaggtgatcctcccgccttggtctcccaaagtgctgggattacaggtgtgagccactgtgcccggccgagaggagttgttttgagactcacctgccatcataggaaccatagcttaaattcttgtgaccttttcaggtgcatctcccaaaatatctcccctccaccaaattaatgatttatttcataaatttagttgcattctggatggtctcattcttaagatgagcttaaagcctttcagaccagtcacttccttgtttggggtggaggaggttttttcctggaataggacagtgtatggaagggttgagaatccacttctttagcggttaataatttactccgagtaaggaattctttgttaaagtggggcatgttcttcaagtgccagagaagagagaagggtgatttttctgacatcctccagcctgcttctccatatttggaaatgtttacccaccaggctgatctattggaagagagggaggtgactcagggtttaggagaagcaggatttgaattcttgtttccagaaacaaagtcgtccccccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtgtgagtacatcattactgccatttctgctcacagacctggggcttacagcctgtgggctggctcacttgcatggtgatgggacacgttgctgggagtgctggtcacttttatttgggggtgtggacagctgctttcccaggggagtacttcttacagtgggatttcaagacaagatcggcctgaagaaaaattatatttgtatattttttaaaaagtaggtatttcctctcatctgaggcctaacttgagttgggtagaaagacaatttgggagtgctgttgtctgatgattaaggctaaagcaacaagctggaagggatgtcgggatgtctgtggacatgtagggaggggtagttttagcttgaaaacagttatggtgggatttaagagtatgcaaaatgttgatgtgtagcatttgcacagcatccacggtctggaataccttgtgtgcaggtcactgtgtagatttgatgagttgtcagagttggaagagtcctgcagagttttcagcacatctgtctaatttcacagtgtgagataatgggcagcagagacccaggccctgaagacagatggctcattatgtgggattagaacccagatcttctctctcagttcgttctccttcccctagacttaagctgccccctctattgcgagatgaggaaattgggagatgttagaactgtccacacttactaatctagttggtgggaaattgaggactagaacctacttctagttcagacctcttcccgttaggatatatgggctcagatgcctagatttgttgtttttgtatgaggctcttttcttttctttttgttctttgatttttacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaactgggattacaggcatgcaccactaggcctggctaatttttgtatttttagtagagacagggtttcaccacgttggccaggctggtctcaaactcctgacctcaggtgatctgcctgccttggcctcccaaagtgctgggattacaggcatgagctgctgcacctggcctcggatcaacttgagggccttattttccagtgcagggaagatggtagaaatatgttttggggaagcattttattaccagtggcattaggtggcagatgtaatagagcagaggaagtgctctgagacctatgtttgttctggccagttttaaagagaggggaagcgactctctaatctgctttgaagcaagtgggaggagggaagttgcacaggactcccaggaacctgtacacaatctgtctccttctgtgaccagctgaggctgggtggtgactgtaagccctgttcatgagacaggaggagagagccttgaagaaggaaagcctggggtgtttttctgtggtgctgagggacagggacagtaagaggttggagtaaataataccagtatgaatactaatactctgaataaggacagctgacaagcattggttgcttaatgggtgccaagcacagggctaaacactttacctaaattattgtggcactatagctgcctttgagtaggaactattttttaaaatattatttttaattttggtgtaatacatataaaatttgccatcttgatggtttttaagagtacagttcaagcctgggcatggtggctcacgcctgtaatcccagcactttgagaggccgaggtgggcagatcacttgagcccaggaattcaagtccagcttggccaacgtgatgaatccccacctctactaaaaatacaaacattagctgggcctggttgcatgcacctgtggtcccagctactcagaaggtggggatgggaggattgcttgaatccagggagtggaggttgcagtgagccaagattgccccactgcactttaacctggatgacagatcgagaccctgtctcagaaaaagaaaaaaaaaaaagagtacagttcagcagtgttaaatacattcatattgctgtgtaatcagtctccaggcctctttcatcttgcaatctgaaactttgtacctataagcaacagctacccattttcctctcctccagcccctggcatcctccattctactttctttctctatgaatgtgactactctaggttctgtatctaagtggaatcataccgtatttgtctttttgtgactggcttatttcactaagcgtagtgtccttaaggttcatccatgttgtagcatgggtcagaatttctcctttttaagggtgaattatattctgtggtaatgaatataccacattttgtctatccatttaggtactattttttaacctccatgttatagaagaacagcaaccagagacttcaaagggttaattaagtaagtggcccaaagtcacatagtcagtagtggagactaattttacctaagaatggcatgtgatcaggagtaagcagatattggattctaattggcaagagtgtgacaaatcagggtgcttctcaactggatggtgacacctccttacaccttgctatggcatttcaataaagcaagtgttccaaagggctgtacgcagctatgcttcctttcttttgtattgggctctaggaagcccatagctaaatttaaagctcacctctagcaaatggtatgagacatccagctcttattttttgtatccctttctcctttctttgctttattttctcctctccttacccactttctcacttaaatcatgaactattagcatcttttgtcaggtacctcagatcatttctggaacaaggcagaatatatagatatgtggcatgatatctaatattttagtaattattaagtctgtggaatagtaggccaaaactggccatgatttttctgacttgactctgctcgtcttcttcttcttccttttttttttttttttttgatggagtctcactctcttgcctagactggagtgcagggcgtgatcttggctcactgcaacctctgcttcatgggttcaagccattctcctgcctcagcctcccgagtagctaggactacaggcacttgccactacaccccactaatttttgtatttttagtagagacggggtttcaccatgttgaccaggctggttttcaactcctgacctcaggtgatctgcctgcttcagcctcccaaagtgatgggattacaggcatgagccaccacaccccacctaactctgctcataatgcaatgtttcatctgggcaatgccctgcccctttctgagtctcacttttctcacctgaaagaggaggttactgttgatgacagtgaacatttaggctgtgctgagttttacactaagcatcctgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcaggcttcttccatccgtggcatgtattcatctaattttattaaatctttattgagtttccacttaggtgccttgcactgttctgggcattatcccagtactcgatttagagcaaagagtaagacacacacaacaacgatctcttggtgcttacacgctgctgcaggtgtgtgaaggaggcagataaaggaacacttaaacaagagggactgataagtaacccaagggaggagtcacaaagggcattctgactgtgagtgagtggggaaggactctgggaggttatgtttaagctgagatctgagtgacaaggaggccaccttgtagaagttgggggaagagcactgcaggcagtggagacggtcaatgcaaaggtcaaggctgtgaagtgggaaggagtttgtgtttgaggaacagaaggagactgatgtgctggcaggatgtgggctgcaggggaagaagcaggagaaaagaatagggtctagcaggtggtggtaagtgagagacctgagcttcttagacctgagtccagatgtgatgggttatgtgttacaggcatctttccagctgctgtggagggaacctgatagtaaaagggagtcaagggtagaagcaagaaggttaggctagacttttaccgtaattcaggtgtgatgtggtggtaactttgactagggcatagaagttgggcaggagaggtaagtttggggcatgtttgggagtgatcgtctataggatctcaagtgtgatttccttcagagaaatgctgagctaaatgggcaggaatctgggatactcagagggaaatgaaaataggtgccctagggggttgcccagataagcagctggcgttccaagaccaaagagtatctgtttctcacccctctcccatttagtttctaaccttgagctttgggccagtgcacagaggatggtggcttcctgcctttggcttcccagctgagagctgttggaacgccccaaaataagccctgcagaacgtgcagcttcctttgctctccctgggtatttttgtaaaacattctttcccaccaagaatgaggaacgttcagagtgatgctgactttatgggctgtatttaacatgttgttttttcatggtgttgtctgttcatgcagagatttctgtctcctgtaaactccctggtaaggaatcttcaatctccatgtgagatgggtctggaaggctcagtgggagcccagaagagctggggtttgaaagcctctccttgtcttgaggactggactgcggtccaagggcacctaccagccctcttttttcatttacatttgaattcacagttgctgccctttggcagttccctgtaattccttttaacaggctgggctttcctgcagatacttcatttttcaggtcttggagaagttaggtagtggctgaatcaggtagagaatccaaaattctgaccaagccccatcctctagccaccaggccaaagcaacttagcttgtgacctcatcctcctgtgtatcccctggcaatcttatactataatcagcctaagcccagagatgctcagaaatcatacactaagtcatctaaaactcatttctgaggctttctcatgcgcccctcttgcagtctgtagttaccaggttttcaaataattagcataatctcttaaaaacagtgttttgttattgctcattcaagtttcttctaaaatttcttttatattacctattcattgagttgacaaacatttattgagttcttactgtatgccaggcattgtgctaggtgctggggattgattcaaagataatttggaggcgtatggaaggggagtggataattacagcacagtgagataagtgctataatagggggatatataaagagccagaaatagcactatgaataacatctttgaacaaattgccttcttttttccttttggattattcccttatgtatattgcccaaagtgggattactgggtcatttaaaagatgaaaacaatttggcacaaaaagatgtaatgacttgcctggggaatacagctcaattttcaacagagaaagaaaaaattgttgacaaatccagatttagatcactttaccaggaagatggggcagtttttatactaccctttcaacatggtggcttttaggggcggggtgggggggatttattctaaacatgttagcctgcgtgtaggaatcacacgtcctcatatttaatctcacaacttgattgttctcacaagaacctagctgtatacatattatcgtttccattttacaaatgaagaaactgcacccttgataaaaggaagtaagttgctcaaaattccatagttaataagtgtagaatccaagggtcaagcacagttccttttattctttgactctatcctgttccccatgctgtgtttaccaattgagggtacctgtgctctagccggggcccggaatttaatatttaatgagtcacggaggctcttaagatgatggtcaggctctatgaaataggtgtagattttcttacctctgaagtcatagccagggaacaatgtctttctgtatattgacctgaaaggacccaagggcgcattattcctgaccctggctcaggtgctgaaaggctatttgcatagccctactgttagagcacagaatcccaagtaaagctgaaaccatgccacagttttgctgtgaaacatttattacttttctagtacttaacagtattaagtaaaaactcctgcccctggtatccaggacctgtcataaatggacaccaacatcggtccactgtgggtccatgtgggtccttgatgctcctgcttacatatctttaaatcaaacacatttcctaccaacccccagatatatcttgcactttctcaccttcatgccttagcacatgcctttcctttagcctgagataacctctccaatcttcattcatagaactcccaatcctcctgtaaacttctgcacagacgccatcttgggaagggaataatccttgatcaccacctgctctcccatccattagaagtgatctctgtgttctctgttctgctaactcaaccacagttagctgtgaggcaatagagtacaaatgtatgctgcatatgagcatgggatatggatttgaatcccggctgtgatacttcctcactgtcagttaacttgcttgagcctgagttttcccatctgccagatgggtgtgatacaataggtgctccccctgaaacccaccatgttgacaggagtagtataaaaatggtctgattctcccggtgaggtcacgtaaatctggaatcgtcaacaattttcctttcctttgttgtcatgacttttttttatgacatcacctcatgtcatgtcaccgtgtggtatgaaaatttgcattgttacctgtgcttcttctgtggcacttgtcctcccttacttgatgtcttatctctccttctagactgggagctcttcaagggcagggagggcattgcatctttgaaggccttgacatatggatactgctacaaagtttcctttaagggaaaggaggattccatacaacctaagtggtgacatcagcacaggctcattactaatctcatgtcacgaggtttcaggcctggctgagaactctgtgagctctgtgatgttgagcttcaggcacatagagtacaagctgggtaggcctctggctcctgcttaagagacagcagaaaggctggatggagcctgtctccagaccagcttcttctgattcaaggagttgggtgggactggcagttcactgaaggcagagtggtagtcctgcttggaacgtgaaactttgtttctttcctgggccttccagtgggtctgttatgttggtgagagtttcagacctagaggaaagggtcactgaaggtatgggttaagagcaactctgaaagccacctgccccccgacttctctgtgagtggggccacagggagaagatcccttcataggtagctcccctacccttgctatgcttggaaactgaccatggaaagggattcatttcttaaagggatagggctaccatttaactttctattgtgtcacttcccgaaacgcaacacctatggcttaagatccaagtgctttagaacatgagatacaaggtcttccaggctctggctgccacatccctttccaggcgtgtgtcccaccacattcctctgcatcctctgtcactggcctcaccagattagtcactttctctgagaacaccctgaactcatccttctcaaggcctttgcacattgtgttccctgagcctatttttctcctcctcatccgtggaaatcctcttgggtgttcaggcatcgtttagaagtcacatcatctgcagagaacttttagaccctcaaaaggacgttgcatgtactcgtgcttttctacacttttcattctgtcttttgtgttccagtgtgtcccccattgaggctcttcgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttgtttttatcccaaagctccatgaaatatgaaaatagcaggagttttaaaggtatatttccacctctagaggaagaactgtccatattatagttgtaattataaattaataaagcctgtgtcatgaaacttgattttgaacgcctgtgttcaaatcctggctttaccacttactagcctagagatattggatgagtgtctaacttctccgttcctcagtttcttcagtgttcaattgggaaatttttcttatggttgatggaaagtttaaataaggtcttggatatgaaactgggattttattagtgtgtgtgtttcaaaatgtggatttggaggccatttaaaaatagcatttccaaaaagtttgcttttaaagcaaagtacttagatatataaatttttatgaattttttttcaaatgataaaataaatgagtttacagtcaggagacatacagtatctaacaaacttagggaatatgcttggcttacaagacgtggttttagtccacataaattagaatcacagaactataggctttgagaaattataaaagccttggaaggggtgaacgtgaattagtgcatattgtgtgcaggctttgtgccatacgtgctagatatgggatcccaggaaatggttgcatacaccttgttgggtagatgatattaaccctgttttgcagacagagaaacctgagctttgagaaaatcctttacacaagtccaatatcaaagtctggaacttcaaactgcactcctgatggcttctagaaatcctttccatttacagatatgacaagacttgctttcacattgttgattttttttttatcctctctttctctgtctctgggggcagcactaattcagggccagatagaactgtgaaaatctgcagtgttgatgtcacataacttgtttaatgaatctagattagtgtcttgacttttcctgccaagaatctgctcataaagtgtcttgttttgagctcctttaactgtactcattcatcagcctttacttattttcttctcttttggagagatacttgccattgcccataatgtttgaggtcaggagtatatttgaagagggctttatattttcttaaaaaaaatacaggtggaaaatcaagtttatcagctatttcataccatcttcttctgccatttatgggcaacatgtggaagaggtggcagggagctgggagtttggaataatgtgtctcatcttgaatttgtcgctgaccagggaaaatactcaaggccaactccatcattcccttttgggaattcggtgcttcagctgtaaagagtgagggcactactaggtgattcctaagatttaaaattctgcatgttttgtggtgtcaaaaccatcaatttctggtgagctgcgtgatcctgcagctgtttctctgatacttttcaatctttagatttaatctattcaacaatgtataattttttaaagggaagcttttatagatacttctgaactataaccgggtgggggggataaatggatgttaaaaaatagaaaacaaccaattaaatagtatatagcatgtaattctccttggaaacttaccacgaaattgagaagcactttaacaactggtaatttaaattgcgtttgaactctgctaatggtttgtttgcatgggaacttcaatcatttcacagtggttctttagcaaagctgcttgttctctttatggaaaataagaaaaaattattaaaagagaagttggctatggaaaatggagaccactttcatttgtgcctggagggaagctggagagtgtgagtgagactccctcagggccaagggtggagagctcttcctttcagtgaagtttaaaaatctgggaagtcagatgccctttgctgctgttgtagaaactgttgtgatttgtatctctctctgcaaggagaagctttggttttatgcagcttgcgggtgagggtagggacaacctttttcgtttgttttatgaaattgcattgttcacaggtctaatgttggcttcctaacaacccatttctcagtaagtttgaaattatgcctctctctcctttcagtggaaatggctttcagaattccaatgtccttgaagaccactaggtctcaggaaactccttgcttttctgggctgatagtgattatactccattttgcctacttaatttctgtctgctgttgaggttactgggagagcgttgaaataggtgttcgaggcctggatttgtaagtcctggtttggctctaggtgtgactcatgtgaccaagcacaagtccctctgcccagtgtgttttgttgtcctttgtcaaagcaagcagtcacttgatccagtggatcaagtggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctcgtatgtggatttctcctgcatacatgaaagacaagttttataacagcccttgccttgggatacttgtctgttggcatacatactgtgtaatcattagcaaaacaataatagttgctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatggctgaaggcaaaggaggagcaggtgtctcagatggcaaaagcaggagcaagagagggagtaggcagaggagttgccacacacttttaaatgaccagatatcatgagaacacactcgtgatcgtgaggacagcaccaagaggatggtgctaaaccattcatgagaaatccgcccccatcatccaatcacctctgcaggccccacctccaacagcaggtattacaactcaacatgaaattcagaggggacacatatccaaatgatatcaaggacggcttactgggaaatgtcaagattgtttatccctctgctgctcactgattctcacttttcaggcaaggaaactaaagttcaaagaacattaggtcctatagttagaaatttgtctccaaactcatattccttttctttttttatttggtatagtttaggtttatctgttaatttttttcttccctacaatttgagtatctaactgacttgcctctttcacctccattattaagatgaagctgttttcccaggagaactaggagagctgagatatgaacactgaggcatcagcattctctttccccatcattctgagtcaaattagtgaaataagagtgccaggatctgactaggagtttaggaggtatagaagtaaaccacggcccagtcagagactttataagcctgggaatttctgaagctggttaagaccctagagatacataagcaacacccttctgtttttcataggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtactcacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatgcctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcttggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatatgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgaggttgagtgaggtcacttttcacctctttgtcttctttgcttcctaggagttatgatgtccccactattcaaatttatgtcaaagatggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattattggttcccagtgcatatgaaatttatgtttacactatactgtagtctcttaagtgtgaaatagcattatgtctaaaaatacagtatacataccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtactggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtgacacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgctttttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggtaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatacttgtgtatgcaaagactttaacatttattaataattttttctatagattggtgaaattggtttgtaatttttgtcatttcacttttgtggaaattgagcaaaagtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctttctctttctttctttctctttctttctttctttttctttctttcttttctttttctctttctctctttcttttctttttctttcactctctctctctttctttcttctgtttcccctcccttccttcctcccttcccttcccttcccttcccttcccttcccttcccttcccttcccttcccttccctcccctcccctgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctttctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacatgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttatagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctgctgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgaagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttcgctcagactcaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctgtctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggatttttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgtcctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaagaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtagatgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatctttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaactttttttttctttgaaacggagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcaccccccaccctccaactctgtctctctctctctctctctctctctttctctctctctctctctctctctctctctgtctgtcctcctctcctgctgttgccatgtgaagtgcctgctcccttttgacttctgccacgttgggaagcttcctgagcctccacagaaggagatgctgctatgtttcctctatagcctgtagaactgtgagccaataattcaacaactcaaccacttcttttcttttctttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacccatttcttaatctctctaagagacatggactgtgttaaagtgtgtttatgaactggtggtcgagggtgcatttccctcctaagaaaactcattccttgttatgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttattctccattcccatgatttagccctctaacttcatgcatttctttttgccctttttcttgtgctggattttagcccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacacgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacccgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaatttgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagtgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaatttttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacagaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttatatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcggatcctctatttcctaattcatggcaacttctggagaacagtattttctctgttactgctttatggggtttagtgtggaaattaaagaagagaacttcttattttttgtaaataataatacaatattcagatactgttagtttctgaaatttaaaatgggcatctcacttctgtgttccctccccaaataaatgtattgatactaaaaaggaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttatttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagtggaggtgtaaaaactagtcttccagcctccagtcctgtctcagcattgctccccttcacgtcgttgtccagagctcctggtggagccttggccttttccatatgtacacgtgcacacacacacacatacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctctctctccaccccccaccccccacccccacccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggaggttattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttctctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagcgtcctgaccatctgtttctttctaccccaggcccattcccatcatgagtatttattctgcccagtgtgggatgggttctgttctagaagtttgcatgagcagagggaagcttagccccatgaggccagtcatgaggctccatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccgttaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccatttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagactttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcaacctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattctcagggagtttagagacaacataatgaaggtattttcaaggtttggggagctgcttggaacttgattttggacaaaatggaaggaaaacaaccatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttgtggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcacagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggtgtgcaccaccatgtccagctaatttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacccatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttctctcctcctcctcctccttctcccttctcccttctcctttctccttctcctcctccctcctctccttctccttcttctttttcttcttcttctttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccggagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacagaaagataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaattttttttttttagttattcttattttctaattattttatatgctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttcttttttttttctgttttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtcctttgtagggacatggatgaacctggaaaccatcattctcagcaaactatcgcaaggacagaaaaccaaagaccgcatgttcttactcacaggtgggaattgaacaatgagaatgcttggacacaggaaagggaacatcacacactggggcctgtcatggggttgggggacgggggagggatagcattaggagatatacctaatgtaaatgacgagttaatgggtgcagcaaaccaacatggcacatgtatacatatgtaacaaatctgcacgttgtgcacatgtaccccagaacttaaaatattaaaaaaaagaaaaaaaaaagaatttgcatctatttttagactttctgttctattcatctgtcacttcatgtgtcattattatgctttcaattattgtagctttataatatgttttattatctgacaaagattccccattcctattagtttctctttttcagaaaatttctggcttttaatgcctgtttatttttcattgacctttataatgaacctatctagttctggctgggcgtggtggctcacgcctgtaatcccagcacttcgggtggctgaggtgggcagatcacttgaggtcagaagttcaagaccagcctggccaacatggtgaaaccctatctactaagaatacaaaaattagccaagtgtggtggcgggcacctgtagtcccagctactcgggaggctgaggcaggagaatcgcttgaactgggaggtggaggttgcagtgagccaagatcccgccactgcactccagcctgggtgacagagtgagactccgtctcaaaaaaaaaaaaaaataaaataaaataatgtaaaaaagttctgttgatatacttatgaggtttgctgggtttatttgttagcattacatgctatacattgtaaaaatgttgattctttttcttggaatactaatgcctttccatttgttgaaaccttctttgatgttcccaggagcactgagatttttcttcatgtagaccgtgcctgtttctaataagttaattttgtagatattttctacttgctctagttaatgtaattattttctatttcatttaattatatgtgtgtgtgcctctgtgtttggggtctggatttcagtacattgattttctgctcagccactttactgaattgtctcattatttgaataattttagataaattttttttgagtttctagttaagtaagtatattatctgccaataatttatcctttctttccaatttttacaacacttatagctttcttctaactgtactaatacctctagaatagtaaatattaaataactgtggttgagtaaatgtccttcttttgtgtctgagtttaatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaacatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcttttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaaccatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggaggttgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctggggggaagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgtcaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaaaaaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagtgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttaggcatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgtttgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatagtcatcttccatcttcactttagaggtgggggaaaagggcattagagtgattgtgtggtaaaatccactctaattctagctgtgagaaaaagagcggtgaaaatgtggtaagcaattgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccattcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcatcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaaggccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttaaagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctaactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagtctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcgcaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgttttcccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgttttttttttttcctttggatatatgaccagcagtgggattgctggatcttacgatatttctttcttttttttttttttttttttgagacggagttttgctgtgtcaccaggctggagtgcagtggtgctatctggctcactgcaagctccgcctcctggcctcctgggttcaagcgtttctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtggttttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcctctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccattctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaagggaatggtttgagacataatggtcattgtgatttttcaagctataaaataaagcatgatgttaaaagatgattaatgttttcatttggtggtagatgacaagtttcttgcagggcatctgatcaatcatgctcttttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgcgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatatatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtaaacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacccacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctagtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccacgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttctcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcacgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgacaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacaatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcatgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcgaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgccttactctcactgccatactcctttggacatcctccttctcttgtttcctgatacttttacatccccttccatcctttactccttagcttttgtttttatttgcagtgttaaagatagcctctttttatttccctgtagtgattagatcgacgtgtttacaatatgaacacacacgttttctcttcttcaggctctgagtcatcgagttcacaatgccatgtctagtcagtacttctatgtgtgtatagtgcccattgtggccgagtagagataaggtcactgcggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttattttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctaggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttctattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaagaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgcttttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttctttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggctttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactctcacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcaatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagaggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttttttttttttttttttgagatggagacttgctcttgtcgcccaggctggagtgcagtggcgcgatctcaactcaccacaacctctgcttcctgggttcaaacgattctcctgcctcagcctcccaagcagctgggattgcaggtgtgcaccacgacacctggctaattatttttgtatatttagtagagacggggtttcgccatgttggccaggctggtcttgaactcctgacctcaagtgatccgcccgtcttggcttcccaaactgctgggattacagacgtgagccactatgccaggccagttgtgggaattttataagggctttttcttttctttttttttttctccctctggcctagtttgtggggagaggtatgtttccccaaagatgtggagttagcctgttgatgtaggcatgggagagtgagcttagacagagatgcctctcatataaggtagaaagccttccatgcccaacccaagtgttgtagaagttgaaaggggaaaaaactttttcaaaattggcttgacagcaaaactcctctcagtgtcttcttttttgtccccctctataaatggtaggttttcgtagtatcatgaccctttttagtaattataaattaatataagataaatttatggtattccttactatatagatttgttaaaataattcacgatatttcatatgtacacacaagctccttcaatccaattagtaagaaaaacacttcatgtcactgttaaataacatgaaaataaacaactggttaaaaaacaaaacccaaatacaaagcgttgagcttcctactggaatctgaatctgggagtgtcttgttgtaagaaatgttttcagacctatcattttcttttgtttctttttctttttttctaaacagactcttgtcagttctcttctgattagtgttcccctgggcttttcttcccaaaataaagttaagtgcattcaagtttctgggatcttctttacatccttttgaaaatgcagagtaaatattatgttggcttctttttgttttttttttttaaattttattattattatactttaagttttagggtacatgtgtacaacgtgcaggtttgttacatatgtatacatgtgctatgttagtgtgctgcacccattaactcgtcatttagcattaggtgtatctcctaatgctatccctcccacctcccctaaccccacaacaggccccggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaactcatcatttttatggctgcatagtattccatggtgtatatgtgtcacattttcttaatccagtctattgttgttggacatttgggttggttcgaagtctttgctattgtgaatagtgccgctataaacatacgtgtgcatgtgtctttatagcagcatgatttataatcctttgggtataaacccagtaatgggatggctgggtcaaatggtatttctagttctagatccctgaggaatcgccacactgacttccacaatggttgaactagttcacagtcccaccaaaagtgtaaaagtgttcctatttctccacatcttctccagcacctgttgtttcctgactttttaatgatcaccattctaactggtgtgagatggtatctcattgtggttttgatttgcatttctctgatggccagtgatgatgagccttttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagtttccccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcgtctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttggtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtgctgaaaaaaatgtgtattctgtcgatttggggtggagagttctgtagatgtctattaggtctgcttggtgcagagctgagttcaattcctgggtatccttgttaactttctgtcttgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgcctttttttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgagagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcggctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcattcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcaagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaaatagcatttacattttggctcttgaaataactaacagcatgtcatttccaaagagacgttaatcattgataccaccagcagcaaatgttctcattcatcagaccacatttgttttacacgttcctctccttagaaagagataagtatggtttcttttctttagttcttgctaataggatacccaacatattgaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtagtgtatgtatgtgcatgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaattcaaaaatcagtcaggcatggtggcacatgcctgtaatcccagttacttgggaggctgaggcaggagaatcgcttgaaccacgaagtcggaggttgcagtgagctgagattgcgtcactgcactccagcctgggcgacagagcgagactctgtctcaaaaaaaaaaaaaaaaaaaaaaaaaaaaaaaaaaaatttcagaagtcccggagtcctttccatgatgcatttgaagggccagagagatagaggcatgccctatgtagtacatcttgctgctgtccctcgtgtgtttaccctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcgcgcacacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtgcaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcgtgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggcagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacatttttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagtcttagtattttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaacagcctggttcatttttactgtgttgccattggttaatgcttaaccagattttgtctctgtttcaaaatcttgaaataaaagtggaacaacttccaacatgacttaagaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccgttaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataataatcaaggacttagaagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggttctctatgaccttttagctcttaagtagtctgtcctggctattgtcaaccatgtctttttttccttgactgatagaaactgtggcaaactaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacgggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagccaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgtttaaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctacgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgactgtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcgagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttgtatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttccttggagaagttagggaaatgttcacagagttagagacatttgagctgagacaatataaaaatatagggcttggtagaacgtgaagagagggaaacggcattgttgatggtgaacacagcatgagcaagggttcagaatcatgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctccggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggcctctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaacgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggtttttttttttgtttgtttgtttttttttttttttttttgagatggagtttcactcttgttgcccaggctggagtgcaatggcattatttcggctcactgcaacctccgcttcccgggttcaagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataactttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggcggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggacaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaattcgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattaaccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacatactttttgatggcattgtttgtttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaatgcttttctttatcaatgttgaatattggcccccattctcttctggcttgtagagtttctgcagagagatctgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgacctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaatcctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcattacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcatatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgcttgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgcgcctgtatacatcagatatatggattgatgcagtgtactctctctcccttaatatgtgtgtgtgtgtgtgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatgtattcttttgtagtgttgcttacgttttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcccaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatggtctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacaatctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcctggcagggttatcttacgctattgaacctcagtttctccatttatccaatagagatggaaagtattggcctgcatttatttctccttcaaatgacatattgtatagaagcgtatcgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaaaatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacgattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgatttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattacaccatagcagtccagcctgggcgacagagtgagactgcctcaaaaaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagacgatctctgtcagttttgcctaggacgttcagtgggacttgggtaggagactgtggactaatctcacctctggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttactgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcacagaagcctaacgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgtgagttagatttgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcacatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagacagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgaatacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcacacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgtttatggaaaaggagattaaagaatgcagtgtgggttttttttcgtggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctgtgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaaggtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacacttcctttcacgtttgtaaactagttatagatttggtacatgtagtcagtcactgtgctaaattctccttaagaattacgtctcttttttgaaaaactaacttttaaaatagacattattattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatgcatgtgtgtgtgtgtgtgtgtgtgtgtgtgtgtgtgtgtgtgtgtgtgttacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccatttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttgcaagagtccaatgctgcataatattaataaacttaattttcttaaattttcttctctggcagagaccataagcagtatgatatttagtcatgctaggataagacctgagtagaaattgtactagctatccagctcgtttgttaatttacttttgatgaggcagagaacggtcatttaaccagcttttgttcagtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaatattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgatgagtgggttgggattaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatatgctgtgtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtacgatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaacaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtaaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacattctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatataggtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacgctccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacatacaggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatgcagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcaaactgcctggcatggtgcgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaggctactcctccataaatagaaaagatctcttctccaacacatcaaaaacattatttttaataggaaaataacaaataaagaacaggttaaaaggtagaagtttctgtttccccaatacagttttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttataagccatcctagggagctcatgaatttcatgagtgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaatggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccgtggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcagcagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggtaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattgatctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcatttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttgggatatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacgcggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtgctcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatcgttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctttggcttttccacattaaatttctcctcttggtttatttttcagagtactctatgacctacctcatcctatgtagcacactgtatctcccactgtcctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcaatctcggctcactgcaagctccgcctcccgggttcacgccattctcctgcctcagcctcccaagtagctgggactacaggcgcccaccaccacacctggctaattttttgtatttttagtagagacggggtttcactgtgttagtcaggatggtcttgatctcctggcctcgtggtccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccccagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgtttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctccttcctttccctcccttccctcccttccttccctccctgccttcctccctcccctctctccctccctccctcccttgtccctcttgcctgaacttcatatcagtgtgtcttgaatatttgaaaaatatttataggaaagtgaatgaaacctatcctaaatggagaagtagatggcaaaaaagggtattagagcttggcttttcaattgtaattgtagccatgacctaatttttggtaatctaataggcccatataatctctgcttggtgttagaagggaagacctttcaccttttgtgttttcttcctaatgtcatgcaaagtgctagagctttggagcaaaatgtttgatttccaaattccaattcttccatttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtttcaatgagccaaggttgcagtgagtgccattgcgctctagtctgggcaacaagagcaaaacccggtctataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggtgttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgctttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgaggctctcatcagaaactgtctggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctctttccataaaatgatatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacatggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagaaggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacagttgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagaaatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccgtccgtccttccttccttccttccttccttccttccttccttccttccttccttcctctctctctcttctttctttctctttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaggtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttggagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatctgaaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggttgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcactgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtgcagagaggtttcaggttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttgtgtgaacctgtccatgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccaagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgcgcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacagtagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaagaaaacagaggactattatgttactatttcctaaataaagaccaatatgataaattccttatattcagtgagaggaaagaagttgcttaccgaatgtactgatatatgcttccttttttcagaaaacaacaacatcaaccaaaacacctgtataattattacatgaatttttttttttttttttttttttgatatggagtttcagtcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatgtcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgggccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttaaaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtaggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaatattggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttatggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacacacacagacacacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttaattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatatgtgtgtgtgtgtgtgtgtgtgtgtggtatattatctatttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgtgtttttttttgttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaataactaccataatttaaaaatgcaaatgtagcaatgcactaaaaaatacctttagcttattttttgttaagaaacaagtgttttgcataatcagactttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctcctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaacggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggctttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagaacccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaacatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagacacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcgtaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgtaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggtcgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtggttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcacagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaataacaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaaattaaaaactattacattttttctccctcccttcctttctactgtttccctcctctcctctctttggtttccttccttcctttgttccttcgttccttcgttccttccttccttccttctgtccttcccttccctccctccctccttcctcccctcccctccccttccttcttctttcttgccctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcacttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgcttttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactctcattgggggttgggggggttgggggtgggctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctacttgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaactaggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgtaatatgtgacagttccctgggagtttctcccctcctcgtaggtatttttagcaaaatagtccttaaacattgttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcgtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataatttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttattgagtttcttccctaatttagatctcaagttttgcaaaagaatgacaaattcctttatttaaagaaaaatgaaagcagatctgttaccttctgtcctatgaatgccaattctctatcctggataattagataaataagatatgtataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttacaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgattttctgtccttttatatttcctccttccctctgagggttcacataggagcctccacagccagaggattactttcagaattggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaacgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcattttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcactggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaattccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatatacacacacatatacatatacacacacacacatatatatagcattcttaatctcatatatatataatatatatataatatatatatattatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggtttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcaagttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctcttggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcattttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtctttgaattaaagcaacagggcacaatttcaggagccattgctttcttctaggaaatacctcactattagagctctctttggagatgagaagatttttctcaactttattatgaattccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttggtctgtatatcttgtttttcatgccagtaccatactgttttgattactgtagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatatcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctaccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcaccatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcaataccagtaccatgttgttttggttactgtagccttgtagtatagtttgaagtcaggtagcatgatgcctccagctttgttctttttgcttgggattgccttgtctgtacaggctctttttcatttctatgggttttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaaaaaaagagagagctaacatcttcactttttaaggaaatagacattgcccccatgattgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatactttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcgaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttccctttccctttccctttccctttcccttcccttcccttctccttctccttctccttccttccttttccttccttccttccttccttccttccttctctctctttctctcttctttggtgtgctgagaataatctgcagacagtgactctacagataagattgcaaatattttcccttccttcattccttccttctttcctcccttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaataaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagaaaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcattgtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatagtcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagaccccatgttgaagaataagatacatatgctgatgtctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaacctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccatttctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggattgccattaaaataattttgtgcagcagcactgtgaggactcagaatccagaagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcaggtgcggtggctcacacttgtaatcccagcactttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgtaggagtcaggttgcctataaaggcaaggatgtgcatacagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacaatctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggtttttttttattattatataaagccttgcagtgagtcatagaagaaatgcactggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaaaggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataattcataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagatcctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccatttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagtcgtcttgagacaataggttgaagctttcactacatgttcttttagcaaaaaattataaagcatagaggttgagatgggctctggaatcagactacaaagattctgatcttactgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatctctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacacaccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgttaaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcagctcttaccagtgacttcagtgcttccttatacaaggtgcaagcggtgctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggcattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcagatatgtgtcatcttaatattcctattaaccttagaactttgtgactgtgttgggattacttgacatatttgtttatcaatcaacacagtgacagtgacaacgaatgagtaaccagtgttttgtttttgaaacatttgaagaagtgttccatatttctgaagttattagtttagtttaggttagtttagtttagtttagttttaacgacagagtcttgctctgttgcccaggctggagtgcaacagcgtgatctcagctcactgcaacctctgcctcccaggttcaagcaattctccctgcctcagcctcccaagtagctgggattacaggcacctgccaccacacctagctaattttttgtatttttagtagagatagagtttcggcatattggccaggctggtctcaaactcctgacctcaggtggtctgcctgccttggcctcctaactgaagttattttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtagcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacatcatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttgaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactcttggtgttgtacatgttgtgggctttgatgagtgtgtagcatttatttcccgtcatagaatcatgcggaatactttcactgcccctaagaattatccttgctctgcctattattactttctcccccaaccccggtaacccctgaaatttttactggcttcatagttttgccttatcagaatgtcttatagttgggaccctacaatatgcagcctttccatattgccattttactgaataatatacattcaaggttcatccatgtcttctcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttttgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaagattgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggattggggacacctgttacagaatttatactgttaaatgtcacttgatatgcacactaaacctattacaaaccacatattgtcacttgtcataattggacagagctgcaatgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccttcttcttcttcttcttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttggtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggaacagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccagcatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaagcaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacattatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgatgtgaaaacttagcttgtccagccaaactggaggaaggagaggcgggacttattggagtaactgaaaagagaaaaattggaatatgagcagtaccaatactcagtctcttaaggaagggtagagtccctttctttctgtctctgtaatttttttcttttttgtttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcaattggttttgttaacactgctgcaccgaagctctagctgaattcacataatctcatgattttagtaaaggtaacaaaggaaaacgattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctcccacagcattagccttagttatgagtataatacaaaagaagaggaccagccctgctggaaggtaaatgaaaagatggaggaattgaacgattacataacagctgttcagacttgtggtactgattagagtcatttgtagagatgaagcagtgtgtcaagccagtgtgggctagggtatactgggaagttctcacagacagaatgaagtgggttgcggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgtgtgtgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaaatatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattaatcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccgtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatggcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttccctttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcatcttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtaacaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatacgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaatactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcaga

SEQ ID NO: 1966 - DNA, 681115 bp, Homo sapiens
ggaaacattgaacccaaagaatgcaggaagaataaccaataaatatagtagtaaaagaccaaatttttagctctacagttctggaaaatatgcatatcaaaagctaagttatagcatttttgatataatttctacttatgaaaaatattatatatacatatatacacatatatacatatatatacacacacacacacacacacacacacacacacacacacacacatatatatatatacatgaaacttcaaccaaaagaaggaactgtaaggggtctacatgactgggaaaatattaggcctattattaaatctaaatagatcatgaatagttacatgtacatgttgtaatctttacagcaaccaatgtaaaactgtgcagagataccaatataaaatcaatataaaaatcaaaagagcccactaaataatactcaaataatccagaagtagcagaaacagggtggagaggaacaaaagttataaagagaaaaaggaaacttacactaaaattgtaagcttaaatccaaccatgtgaataatttcattaaatgtaaatgaactaagcacatatattaaacacagagtttgtcacactgagaaaaataaaaaacaagagacaagcatgcgattctataataaactctaaatagaagtatatacacaaaagtaaaatgataacacaaataaacacctagttaaaatggcataaagcattacttcaatgttaattgcatcattctgattttctaaattgcatattgtgttgtaagatgccacttttgaggaaaactggttgaagtgtaactaaacctttattacatattttttcaccttaatgtgtatctataattatgtttacagaaaacattaaatgaaagtaaaaggatggaaaagttttatcatgtaatcctgaattaataacacaaacatatagtgtggatatttctttgcgtttcttttttgttgttgtcgttgttttttgaaaaagtctcattctgttgcccagactggagtgcagtggcacaatctcggttcactgcaacctctgcctcccagattcaagtgattctcctgcctcagcctcctgagtagccgggatacaggcgcccgccaccacacccagctaatttttgtatttttagtagagatggggttttgccatgtgggcgaggttggtctcgaacttctgacctcaggtgatgtgttcacctcggcctcccaaagagctggaattacaggcataagccacaacgcctggcctttttttgttttgttttgtttttgagacagtgtctcactctgttgcccaggctggagtgcagtggtgcaatcatggctcactgcagcctcaaactcccaggctcaagcaatcctcccacctcagcttcacaagtagctaagcctacgggcacgcaccaccatgcctggctaattttgcttattttttgtagagacaagatctcactatgttgcccaggctggtctgtaactactgggctcaactgatcctcctgctttggcctcccaaattgctggaattacaggcataagccaccacacctggcccagtatggataattcatgggtaaaaaatgtaatacttgaaaaacaaattagatgttttcttattatttccacatagcagagtactaactgtaggacattgggatgtacttttgaataagaaatgaaggtttaaaaaaagataaaataaaacaaaataagtgcctaaaactgactggtgaggggtttacccaatgcatgagcagtagaaagaatttaattttttgcatccaggatactaaaaagtggaaagatagatttcttttttttcctgttttacttcttttgggttgctctatttgatctaattaaaaagcctattactcctatgctatgctgatggaagagaagtcttctctaacttagtcccagtgagattgcctcctctgggccaacaatgctcatctagaacttggaatttcgataaatccattctgaggtgatgagcagcagcagcaccagaaaagttgatccaggccatctaggaccctccagggaagggctcaggcctgtcaaagaggcctgatagaaactggggcctgcagtcagtcagggacattgaagctctcctgacacggtcccaccagctgggaaaacactcggggtctccctcgggtttgatcagatggcaagttccccattccctgattggcccaaagctttgacctgttggacccggggcctatcaaaggccaggtgtcctctccccattggaaacctccctaggctcaactcttctcttctcattctcctgctggcctgggagcatccaggccaaggggtgaggtggggacagccctacattaagtttttatttcaaggtagaaaatctgtccccttgattgtttgggaaactataaaaagactagggcagctcagggtctaaaatacagcttcagggagtacagagttagagtgcagaaacttcaattccatttactctctagcaatttacctaatatcaaaacatacagttatgttatgtttacaaatatgcacgcacctctattaatatgtgttcataagtacatacacatgcaccattacgtttacacatacatgcatgtaacaccaactgatgtaaaaatcattgttttatgtactcagttttcctttgagtttaccctcttttctctactttttaaaatatttatttctaatttggggagctactaactgagattatttttcatctcactgaaaaacagttttagaatttcctgtagagcagttctgctggtggcaaattccatcgggttttgtctgaaaagtagccattttctcctattttttctgtttattatatagaaagataacttatataaagtaaaattcacaggtcttaattatacagtttgatggtttttacaaatgcagatgctcatgtagccaacagtccgatccattctcacaacatctccattactgcagaatggagacattctgttccagtcaatgtaaattatcccattacacctaccaaatagaacgtgtatgagagacacctttctcctgaggacttttgcaaagtggggtggatcatgtgtcccgctcccactgaaaagggctaaatggaaaactaaagtctgaaataaaataggaggctgccctgacgaggggtcccactttgcccttggacagagaacaggccgtggtcaaggccctggtccgggcagaagcctctgtcaggacccactggcatctggtcacagacacgatggacctgggcctaggcagaagggggtgctgttggtctgctgctgagggctctgtgggtttctcagctgggaaaccaaacacttgaacttggtctccacgcagggttcactggggccagcagctgggctctctctgcacccttggagagcctcaggccaggcccagcccaggtaacccctcccagaaatgtcaccccaccactgggactgacactcaggcacacggagtgatttggttgggcagaggaagaggagcacatttgcatgaagggcccctctctctcctctgggactacagggtgggtaagaaatacctgcaactgtcagcctcagcagagctctggggagtctgcaccatggcttggaccccactcctcttcctcaccctcctcctccactgcacaggtcaggatggccctcagcaccctgacctccagctcactgataccacctcccaaacttatgccaggaatgtccttccctcttttcttgactccagccggtaatgggtgtctgtgttttcagggtctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattcacacagtgacacaggcagatgaggaagtgggacagaaacctcagcctgctcagggtcttgttatatgacaagttttaaattttcaaatatgttttatatgtacacactccacttggaagcaccgtctggtttaaaatgtttctactctcaatttctcattcaagttttctgaagtctcaggaaaactaaaaacagaaacaaaaatatcatgatgactatgaaatattacctaattttccaaatatgctgaattcagtgcctgtggagctaaccattttctcttgacagaagaaaaatgagccttagaaattgtttccaaatcctgaaagagtcatcattccatgtactcaggacagatttagagagtgctgaccctgccctttgaaagatgttatttgcctcttagtgcccaaataaggaaggataattaggaatcagaagcctacctagggctcccctctctcctctcaaaattgcacttggtgtcatattgccctagaatttatgcctggtgctggcaaatatttttaaatttattttttaatcttttccttttctgcaatcaaatttcttgaggggctgagaagaagaaataggcccagagagaagcaaggcagtctgggtgcaggctctagacagcccagggagaagaaagagggagcagctccctgtgtcctggagggagccctgtccccattgggcttcctgctctgatgtcccctagtggaggctcctcagggagtccagcctcccagaactgccctataaacctcacagtgagctaagcaagtatatccaggaaggagggtctgtggagatgtgagactaaggtgtgttatggcctaaacactgcccatctccatccttcttggggatgacaaagtgaacagtggaggagacaggatacatgggtgcatctggacctcaagcagtaggctgttctgtggtctgtccctaaatcttgtgctggagaccccatacgagagccactccctgaccctgggctggagccctctaccccctgctcacaagaccagcagctgtttccttataggcccccagggagccacagaacagcatcaaccaagaccatcctcttcatgtgtcagcttttcagggagggatcgaagtcatggcccaggaaagggcttggacagcccaggggaggaggctggttggtatgaaggatgccctcctcaccctgagctgctggagggagtacaagggacttggagagcccaggctcagttgatgatcctcaggatgtagagctatgtatgggtctccactgtggtctctcccccgccttctccttcactgcacaggtggctagggctcagtgtcagggctggtgatcaaaagaccaaggtttatgcatgtgtctctgtccactgacccacctctcaccctgtgtctgtcttaatgtccagcgtcctgagcccagcctgtgctgacccagccacctgcagtgcatgcatctgtggggcaggtgggtaccagctcctgcactagaagcagcagcaatgttgggcacgggcatgtgctctggtacaaacatgcctccgagagacccagagctccacatatataaaagcagtcattgacccttaggggcataggcccaatgctgaggctccaggttggagaacatggcctctctgagcatctctggactccaggcagaggaaaaggctgatttttattctcagcttgggacacaagcaccaaggctcaggcagtacttcaggccagtggggaagtgggagaaaaagctgctgcccatccagcaatggagcttctctgtgcagcccccacttcttgggcaagtcagctgattaacgttgcttttcatttgtttagtaaaaatttagattttaaaactcactccagtgaacgcagtgtggagaatgtgtttctgtcctctcaattctaccctcacacccaacccttggcagtaacaaattgtcgtattgtctcatattaagagaaatccctcaataccaagatcaggctgtcctggaaaccaaatccataatgggtcaaaacaggaccagggtcattgtgtctgactcaggatagtcgactcccaaaggtctgtttatccacctcattcactgagaagctactatgcaccagcctcagatccagggattcaaggtacatgatgaacaagagaggaaggggccctgtcctcatggagctgacactgagtggtggaacagataaggcaatcaagtaaaaatgtcaatgcgacaatatgatgtcatcacacagtgaggagagctcagttgggggtagaggagccatcagaaggttgggcaaggaagacacaggatctgactcaagtttatgaagaaaagtccagatgcctcaaagaagatgaacaaggagacagcaagcatgaaggccacggggccagttggggtcattggagagaaaggtcaggtctagcctgtgtttgtaagaggagggactgaagcctgggtgaggagagagggctcaggaatagccttggaaagtggagggagtggatgcgaaacccctgctgagggggcctccatgagcaatgaggctgggggaggccctgagctaatcaccatgatggaaactcagacaacagcctcccagcctctttcaaagttgtcacaggacgcttttctctccaaatggcaaggggggaatcccactatgagttttatttgagatgtctcttctccatgtcctgtcctgtccctaggctaaattcccatgcgcaaacaagatactgctcagtctcaggtatcacattcacacacaaatgctccagaatgagggaatgcactctgaccaacccaccaggaatttttgcctttgagaatactagatcagatcactcacaccatctcccctgacaccatcatgttgaccagtgggttgtctgatcggtttggacagcagaatgcagatgcctgtagttgcagctggggtcagtcacatgctcatctcatggctgggagactttgggtccagacaacaggaaaaaaaggaggtttgcctacgtgatcccacaatgtgcatcactctgtcatccactcccatccttagttcatgttgggttttgtcctgtagatgctgggacctggacaggatcacaagccaggcgatttctggctcacaaagttacagctcaagctccctgatgttgctgacattcttcccacagaccaattttagacagacacactattgccatgcaggcactgacctgagatacaggtagtctcaggagagggaggaagcagatacacatccccatgatggcctccttgtcccagagtgggtaagaaaggcaaggaggccaggaagccacaggagtggccactgcccaccacctgtgcacctgtccctccctcaggtgagaagcagcctgagggtccagcacctgcaccttttcccagtgcccacacacttccaagtggggcctccttctgctcacctcccaaagctactgctttccgggacatctgtgtcattgctgagagtctacttttcatggggcccttgtcccagtggtctgggatcagtgtcagcctgtttaattcagcactgtctctgtcctttcaggacaccaatctagctattaaagctctaattgaattctcctttttttgccctgaaactttagactctccttctcagtgtctctctagaatattttgtctctatccaataagatcaagttatgtcttcaggcctacagccacttctttccccaaattctgcaccttcttttaagttcttattccctcttatggcttattttccactaactagctaatgatgccaaaacatttatctattttacctccttcaggaataaaaaagaaaagcatttatcaatagcccattgtcacaaagaaaggaacagaggagagatatcttctagaaaaatacaggtgaacaaggaaaaagttttaattcctcataggaactactccatgatccaagaaaataaattccagagattcaagagttcactccttagaaacaacagtgtaaatacaaggtagtaaattttcttggttttctcaatgaataacctcaaaagggttagagtatgattataataaaaagattatacattactttcaaaaatgtaagatgaacatgtcaaaaattttaatcgactcatatttctgaaaagaccagtaaaatggtgaataattttaaagaacattttaaaacacacagagtttctattccacgagggcaggacctgtgaggataatttcctgtgttagagaaacactgtcctaaacaacaatagtagaactctctaagctctgaatttatcttctcctgtaagaaaaaatctacaaagtgacaggatccaatttatataaaatatctagcaaagattttggacattcccatctcacacctcctctccaggctctcctcaagtgaaatctactctccttctgcccgtgttctcacctttctgcacgcttccgcctgctgacacatggcttctcctgctttcctttccagtagccctaacagatcaggccctgccagtaagtaagctcctggcctgagggaaccacatcgcatgttactggatttctgaggcacttgccctgccagggtctctctttctgaatcacaatccctgtattcctgggaattctcttctcctggattctgttattcagctctgtgtttctccctccatatctactttgtgaatttctctacatcttcacctgaatcccaggaagcctaaggacatgctgatgcttcctcagttctcatgtcacaccctgttccctcctcctctatgatcccaccaggtcatcctgcatcagaaccctgagtgcggcagaggcttctctggcctccttacccccagtggcagaagggaggaagggaggtcccctgtggcctcccatccttgtgctcccattagggtcagcatgaagcaggaatgaggctgtctatatcatcatggcattcccaacactaaactctgtgcccaggagaaggtaggcactcaataactatttgacaattgaagaactgcctctcaccacactggccacattgtactggactcaggatggggctgaactggaagagtcagctgtgaacctgctcttgtctctgccctcagcctgagagctgaaggggaacctaacagggagagcacccatgggcagggaaggtacattagtagcctcatcctgtttgtgaggctctgctcagccttgggaatccctgtttattcaaggcagagaagaaggaaaacaattaaccaggcctggccaacaggcagcatctacaaggcgatgagttgagggccagatggtcagagttggttctggcatctctcaggcgcctctctccatgttgcccttttttgcgatccaggggtgaggtttcaccccactgagcccccacccatctagatgggctctgctgagagaaaaacccattttctagatgagcccactgaggctcaaggggcacatgtacttggtgatgcaccttcttcctttagagactggtcagcctagaacaccccctctcgagtggccttctggtccctcatctgcccagccccacccagatctccatgaacctgagctgtgtgagagaagagggaagagtaggaggaagggaggagtccaggccatggtgtggatgttgcaggaacccctgggtcttcaaactgaggctggacaccgcaatgttctttttatctccctcaaattttttggtaaaatgtcagtgcttgtctggtccattattcaaacctgattctttttaccaccatcataggcatacatttctgagtcttcatcccagagaacagctcctctctaaaggggaggtgtagggtggctgtgagttctgagtttgcccctggggaggaagcacctgctccaccatgtgcacaggcctgtaagcaagagtccaactttgttgaaataggaaccatttgagtttgcttcaggccttgctgacctcagaagtttcacattgtcccctggtgacctcttcacaatgatgttagtggtgatggaacaatgcaggacagaaggccttccttactttctttcaacaaaaaaatggtgtattatctagcctgacagtaccctagctggagacagtgaaaataatttacattttaaacaaataatgtttgttattttttcaatctcatgagtgtaagataaaagtaatcctatctcaataccaaaacaaacaaacacgaaaaaccagaatctgaggagactgaagtgtgttgattgagagacagtaagaataacttagtccagctcccctgcctggctgtgaaatccaatgatccagtgtcccactctacagacaaacctacaggtttttcacccaatgcagacagaagacatggtattgaattcatgagtccccgctgagagtcacaataggctggtgtggcacaatgcattatgggaggcacagaatgaagggacaacatgtattcagtggattctgctctcttatcagactgagtcactgcacagactgctcacagggtttctccactgcattctgcctcacataaataaacaccaagagccataggatattagtcaattatattttctccttcagtgtcatacttgagatctctatcatatttgaaattggactcagagagcttcaattattttgttgcaatatatattatctttacaaaaattacctagactactgtgtttctgaaaaataaatcttacaatttattttacttccatgatggtattaaacttgaatggttagcatatcagccagtagtgtgtctggggctggacaacagagagtgtttggggtccattcctgaagggtgtgtgtgtgctcagagctggcatcatccacctattctgactcctgccctctgctaagtcctcacagctgtgaacttccaaacccctgggacaacacagctccactcctgctcattcccctgatccccaaaggcacagggccctgatcctgacccaaacacagagtgggatcaaaaagctgagaggttgtcacttgcataggtggatttttttcctcaaagagtataaagagagggagaaagattgggagaagctctgcggtagctgtaggcacagaaggcaggaatcaggccaatctccaccatggactggtcccctctcctcctcatactcctcactcactgtacaggtgactagacacaggcccaggggaggagccctgggaagcccaagggactctgctttctcatcttgtctctagaacagtatcaccacttctgtgtctcttccacttccagggtcctgggccaagtctgtgctgactcaacctccatcagtggcaggggccccaagatagagggtcactatctcctgcactggaagtgccaccagcactgggggtggttttcatgttaatgagtactagcagctcccaggaatggctccatagctcctcatttgtgaaaacagccattggccttcagggttctgtcctggttcacaggcttcgctgagcatttctgggctccagtctggggataaggctgactatttttctttatcttggcacacaagcattaatgctcacacagaactgtaggccaccggggaaggaagacaaagatatgctgtctttccagtgacagagtttccctgtgcagcccccaacccattcaccaaataagtgcttaactgtgattttttttggtggacaaaatgtggagtatgagaagcactgaagcaaacatggtctaaataatgtttcccagtcctctctcaattctacccccatatccaacccttggcaataataaattgtcatactgtcatatattgaaataaatatctatattagtccattctcacattgctataaagaactacctgagacagggtaatttatgaagaaaggctcacagtctttaattgactcacagttctgcaggctgtacaggaagcatgaattggaggcctcaggaaacttacaatcatggaggaaggacgaggggagcaagtacatcttgatatggcagagcaggagagagagagaaggggaaatactacgcacttttaaacaaccagaactcacaagaactcactcatgatagtgaatcttaagaacagcaagaaagaaatctgcccccacgatccaatcacctcctaccagcccctcctcagcatgagatttgggtggggacacagagccaagccatatcaattcctcaataccagggtcaggcttccctgggaaccaagtccatcatggatcaggacaggaccaggaacacagcacccactgtgtctgaccaaagagcctcaactgccagatgtctgtccatccacaccattcaattagcacctactatgtgccagccttaggtctaggggctcaaaaacagggtggacaagacaggaagtgtccctgtcctcatggaccagacaccatctggtggaagagatgagacaattgagtaataatatcaatacaataagatgtcatcacttagtgaggagaggagaggagagctcagtaatggtggtagaggagccatcagagggttggacaaggaagacagaggatctgagctaagtttgtgaagaaaagtccagatgcctcagacaagatggacaaggaggtgggaagcatgatggctgtgggtccaactagggtcactgggggagactgtttatacccagcatatgtttgtggggaggagggactgaagcctgggtgaggggagagggctcaaggctggccttaggacatggacaggatggtattgagtcacgctgcagaaggagccttcatgggcaagggggctgggggaggccctgagctcattattccaatggaaatatcaaactgcctgttagcctttgtcaaaggtatcaaagagactttttcattcaagatggcaagagaggaatctccctcttagacttctttgagatattctttcttcatgaccgtttcttgcccctggatgaatgctcacatgggagcaaattacctcctcagtcccaggatttcaatttgcacacaatccccccagaatgatcgagacctgccatccctgacccactgatcaggaattctggccttcaggacaacttgaccagatcagtcacaccatgtcccctgacaccatcgtggtgactggggtgaactgtcagactggtttgggtaatacatgtcctgtccctggagttgcagaacctgttcagaaagataatggtgtggatggagggaggctaattccagccacatcagaaagcaagaaagacatggagaccacccttgagctggcacagcatccttgggtctcacatgtgtctctagcgactggaaaaggaactcagatttaactaattctattttctcatctgtcactctccctttcactactgactcctgaagccccaacaaaagcagcactatgggattatggtcatggaatagaggccttgctgctgaacttttcttttttattctaaaaagtacaacacagataatgcatattaactaaaaattataaaaatgtatttaaatgatgtgacaatgaatgtataaggggttaataggagaaaataataaacaatgttaaaaaatacaaaataccaatacactataagagttatactatgtcatggattgtataaatcagtattgtaaagatggcagtgtcctaggattaatccatcaaattaatataagtgtaattaaaatttcagtaatattttaggaaactgcttaacttattttaaaactcaaattgaaaattgagataaaaattacctaagattatttaccaaaaatttgtaatggaagtgataccagatattgagttatttgaccaagcaatattagctaaaatcatgcatgattgagatcttgacatttacataattctcttaaaaattagagtagataggactgatgattttttatgtgaccttggaaatatggctaactctgttcataaaattaagtagagtacctaattcatacttttattaaaaaatccaaacagatttaaaatataatttagaaaagaaaaagtttaaaaactttagtttggaaaaatagaaatattatttttatttcatatgagaaagtacttcttaaataaacccaaaagtcaattcataaaagaaaatttgaagtatttggttgcaattatttgaagctttttttttcccaaagaggaccacagttggtaaaaagagagaaggatatgcaagagtggaaagacattggcaaggacaaagtattgctgtttgcatccagaagacaactttgaaatgagcgaagacagaaaaaaaggaaacccagtaaaaatgttcaaaggacacaaacaagccattcacgggtctcaaaatgagagcagataaatgtgacatcaaaatatgttaaattccaccagagacaaagagaagggaataagatcttcaagtagaaattgtggaatgagccaagcatgtctgtgcatggggagctttccaggccttgcaaaaagcaaagagagtaagaaaagagcaagaagggagtgagaagcccttttgtagagaaaccaagaaaagaaagtttagagtgttagagcctgggccagaaagataaaagagagagaagaggtagataatgtgggatttgagtgacctttgattcctgtgggcatacttctgagtaagacatgaagccactgagggtggaaagctgttaaatgatattgcaaatttaaataaaaaaaaaagatgccagtgaggatgtggggaatcccaaactctcactcacagcaggttgtaaaaacaaattcagctattttgagcaaagtccctcagcacgaagataccttaagagggtgagcatctgtcttgcaccaagtccactctgtacagagacacaaggaaatgtttatgagaaggtccttactaggggaaaagtataaaaaacaagctagttgtcaaacacaaggggaatttataacctgcagttagctgatggaatgctaactagttggaagtaataaaataaaagtattattatgagtttcaaaggcaataaatatataaataaaattaaaaagccaagagctaaagaaataaattattttaaaatatgaacatgcactataattttttttaagtttataccatgagctatttgaaagttagactggaagcacattatatacacttatgtaagagcctctgaaaaagatggaaacacatacgaaggttaaaagataatttaaaacaatagagagttatttcagtagctgaagatatgagtgccaataaaatgaatgcgattcaaccctgtgagcattgctttcataaaaaaattaaaacagaaaatgaatattaatagatgacttaagtgaaatcacaatgtatgtggtgatacagctgaaagacaaacgttttgttagtaagaagggcatcgctaagcctgatgagtgctttgtttagaattcccagctaccctggattcctctccaacctcatgaacagcttcagaaaagaggatcaggacaaccgatgctcctctcattgaaatgcccggatgtggcagagaggcaggaaatattttgggtctgaggacagtgaggatcatcactgagatgatcctgcccaaatgaaaaccactcagggcctccaagggagttcagccatcagctcactggactaggtttgggatgcaacactgacctgccccgacccagagtcataatgagccaggccacctccacccactgggtcagctcatctcctctttatcttttctccttctgacctgtgagtacccagatcagggtggacaagtaagagacacatagcaaggtcttatgtgaatacagtgactctaccttacgacgtttttgggagatacaaaggtacttagaggagctcagtttccaaagcagtgctccaggaagctggaaatctgcactatgctctgggctcctctcctccatctccaccctcactattcaggtgagaaagaaccttatgtcgggggatccacacccagctctgctccataccccctcactctctggctcactgggttgtaaacctgctctcatggccctctctgtccccctgcagtgtctgtggcccaggcagggcagactcagcagctctctgtatccaagggcttgggatagacaaccacactcacctgcactggggacagcaacaatgttggcaaagatggagctgtctggccgcagcagcaccagggccatgcccccaaacacctgatcaacaggaaaaacagccaactctcagggatctcagagagattccctggctcccggttaggaacatggcatctctgaccatctctggcctccagaccaaggacaagcctgcctattactgctcagcctgggacagcagcctcagtgctcacacagcgcctcaggggaagtgagacgaaaactcaggagctcccctagcttcactcggtatgcgggggcgtcatagagcactgtttaaactaaaccaaaaatgacaagggctggtttccacgtgacaaagtgtgtgctattcaaaactattaaaaataatatcataagttaaaataactaaatctgcagtattaatgaatatttataggaaacattgttgtgaatatatttgtggctagatacttacatgaacatacacatgcattaatcagtagtaaaaatgaatgcaagggtaaactaaggaaatatttattttcccagattttccttctcttttatttggagatgctggactaaatgctcagaggttccggtggtctgcctttgagtgtgtgttcagcagggtcacctcaagcttatcccaccttcttatgacctgggcccatgcctgtcctctcattagaatcccctttccctctgtcacagagctctctttattccttctacagacccagacttgttcctcacacttagttgaggcttcctgggccccacgtccctgtttgcccccaacacccacacaagacaatgatcccatgtgtgtgctcttgttgtgccctttccttatcctctgacatacctcaggcagtatctggaaagaacaaatgaagtgggagcgttagcttgtagttgaaaatgatttttgatattttggggaaaatatctggtttaaagatagttttccatcgagataaaaatgcatgtgtgacagcaccacatttctaatggcggaccaaagccccccacatctttgccccccacatggctccagggacattgacttgttaatatacaacccaggagagagcactgtgtcctatgcaactgcaatgcagaggcaggtttctgcccgctcctccaatgaagtgagtagcaaccccaaccccatcttcacccatcatttagatgacccccatacaaccacaacatagaaacacattgatcaaagggcctttttctctttgcagagacccctatttgtttatttggcatgtgagattttagacttttaccaacaattaaaatatactttattagaaaagttacacttcttaagaaactctgattcttactgtgaagttaatacctaatgcatcctataagcatagtaagtggaaaattgttctgtaaggagaagattaatcaatgaaataaaatacaagtatttgagagcaatctaataggtaaaagattagaggacataattgtgaatgccaggtgcaatataaaggaaatgtgggccgggcatggtggctcaaccctgtaatcccagcactttgggaggccgaggtgggcggatcacctgaggtcaggagctcgacaccagcctggccaacatggagaaaccccatctctactaaatatacaaaaattagccaggtgtggtggtgcatgcttgtagtcccagctactcaggaggctaagggaggagaatcacttgaacccaggaggcggaggttgcagtgagccaagatcacactattgcactttggcctgggtgacagagtgaggctcagcctaaaataaaataaaataaaataaaacaaaggaaatgtgaatacctagagttgattaaattgtggcccctcaccttcaacactcgaaaagctcagagtgggtagaaaagcttgttgagttatcttctgatgtcattgacaagataaatcagggacaatagaaggaatatgtggaaagaggtgccagaggctagaggggaaagtgtgaagtagccagcagagaggagcctgctggctgactacttgtgttagtagtagcaggtggtgttgacgccatctcccaggggaaaaccctgggaaacaggaaagctaaaagcaggctcaccatcctcatccctaacagaaccactgaagtgagcacaccagagtgtggggttccctcccggctcttcagatgacattgttatttggcaccaagctgatgttagtatgttctttataaatatatattgcacaaagaattgcataaaaccttcaataatttaatgaggactttctcacttaaaaaggtttttatgtctcttctgtggcccccataggtagccggggatccctcactgcatttcagtctgacaactcatcacatggacagagtccaccgtgtgtgactgtgtgtctgtgataataggtggcaaagcttcactgtcatagccgcacctgcttcattgcctggtgcttgcctttctgaaataggaaaataaactcttaccaatgtgtcataattaggttctatttaaaatctcctaccaaagttaagagcagcctgcacaactggtccacaaaatgagaaacctccaatttatttggactcttttctctaccctacccagtgatccaactggtcaccagccatgtggattctctctccaaaacgcttttaaattcaactctcctgtttactttccattctcatgtcttatgtcaaatattcatgtcacttacctagttctgatcagttctctggctccatggacagctcccccaactctgccttcctgaccatctctgggctgcggattggagatgaggctgacttctcctgtcagtctcatgatgaaagctacaatctcacagtgctgcaggcccattgggcagtgacaggaaaactccccagagcaccctcaccctgagtctgccatcagcctctccccaccagcatgggttgctttttcctgtcccctgtttgaatgtttgaattcaaattttctgtttatgtgtctctctattttctttccaaaatacacaactttttctttcttgtcttcatggatggtttttctggtccctgtgaaattactttatgaagaatatttagtttaaaacatagtttctgaacattgtcattttaacattgtgcactgggtcattcattgtgtgaggggggctgttctgttcatggttggacatttataagattattgggactcacacatcagatgcctatagcaccctaattcccaaattctaacaaacaagcaaaaaatgtagacattgcaaaatatcctagggagacagcactgcagaatcacccttgtctgagaaccactggattaaaaggacatggtttcacgtattgggcagccttttgtgttgaaccctccttatcccattccactgaatataaggctacatgcattatatctcgatggttccaaatttcctcttaaacaaatgtgtgggatacaactccaaaggttatgttgacagatgaataatcctctgaacaccattagttcagaaaacctgctacccaatgtacagcatctcttgctgaccagagtgtggagtgaaacatttgaccaaactgtgtgcataattgctaattcaaatttttaggtaaaacacctaaaacataacacattcttctctacttatcctcttaggggttgcttttcaagcatggtgtacaaaattatgacaaggcctcgtatgtgtggagtttacattttagaatgggtagacgacagtagacaagagcagcctcagaactgagcagtcagtgaagtcctttttttagccctagcgctggatgcaaattttaccagctgccatttgtgtttttgggcttgctccacccagtacagtccccatgaactgcatgttgatatgtatatttcaaagttaattaattaaaactaaataaactttaaaaaatattcctcagccacaccagcttcatttcacctgcctcctggactcatgctctccatccatggctctcatgctggagagttcagacacagggcatctccaccatggcataaagttctactgcagagcacagtctgtgacaatctatttaacacttccttaggccagtttcttcattacctgtaatggggatatagtaacactcaagttctcttcacagtctggaacactattctctgtgggagtattacctcggccccttcttcctacagaacggaggagtgataatgtaactagtattggccaataagatgaacagaaatgagaggtgtaatttctgagcagtagatgtaagattagcctgtgctttgtcaagttctatcatctctgacgtaacacccacagtgttctcacagaattctctcaaccatcctgcatcctgggatgaaggtgaagtgaactgaagccccaagcatttcaatcagagatgggaatggtggaggagtgagaaatatacattcgttgtgagtcaccaagatttctgtcaatttctcactgcatccaagcctagccagtactgagtgctatggaaattataagtgaatgtggggagccacaatgacaaaattaacatctatctataaatatatataatatatattaattacattatatcatatactaatattaatatataataaatatataatatataacacttacatattatataagtatataatatataacacttacatattatataagtatataatatacaataattaatctatattacatataatatattaatataaatatatatacataatttgatttgatgcaatactgtgaacatttagtagactacggagattgcatgatgtttcattttattcactggcaaatatttaattaagctgtcaccataataaacattaaaacacacagaattgacaaaataattctcctgagctgtggatatacaagttagacaactgattagaagcataggttcactcctgtgccatttgtggaatttttacaacttatttactttaagtgatgattttaagcataattggtttttgttcttgctttttatttattcaagcagaagaaagacacaagaatgataacccacatacatacagagtagtagaatggcaagagctaattattctcaaacacaaattcttaaagataaatgtaaaatatttgaattaaacattttgctatccaaaaaaaggtatgccgtttttttcctgagtactccagggcaggaaagtatattcatcaatccccctggtgtccgctttcttaacacattgttcatattggtatatatttttttcttattacttaacttactcatcctatatattgtgtttcctaaatatatttcaaattcattctcagccttgtgatttccctcgccctcattatgtcccatgtcctgctggggctcccccataccacccctctcctcatctgtaatgccccctcccagttcctgccctcctgggaactgctgtgctcttttctgccctgagccttgttacctccttcttgtactacctatttgtctcagtgagctcctcttccattcttcaaaggctccagagccctagagaagagcatcatctcaaaaaatttcccaagaagctgcaagtaatgagagtgtctaagaccactctttctgctttatggcaattttatatttaacgtggtattgagtcttgctgaattttcagtctgaagtcataatgtgctcaaatatacaaattccagagacacagagcagaatggtggctgccaggagctgaggggaggaggaaatggggagttgctggtcaacaggtgtaaagttttagttatgcaagaatatgttataaagatgtgctgtgcaacacttatctaaatattaattattaatcaaacaaaaaattcaaaattattaacacacatttccccctgggtttactggacagatgattttatatttgtctctgctaagtagactaaggtgtaaggatttggcacgaaagttgtaaaccacaaacccagccaaaaacaaaatattctttatacagtttttcaataaataaaattaatttaatattgctagtttaataaaatagctgtgtcttctaagttatagataaattttgcatatttttcactttaaggatcttacttaggtaaacaactgcatataccaactactaatattactaagaaaaaatgatttagagaaataaaaataattttcttgtgtctcagttttcacatataatctaaataaatttttaagtaactaaattagatgaatataaatgaagtaaacacttctatctaaactttttgtataatttaaaatcttaaaaaataaattaaataataggtactcttaaaaaagtgtaggtcatttaaaattaaaaatatatattttggatatagttataaaaatattaaaatagttctcatgtataaaagatgaatttatgagagacaattcaaagtttcttacatcctaggttttgagtaaaaattattgttaaaataattaaaaattctaattaatatataattcaatatataaaataagacaaaaataaaaatactaaatatatgtttttaagttaaaaaagcaaagtcataaaatatatgctttattaaaataattttgccaagttaagatgttatataatggttacttataaagcaatataaaataaattagagagatataaaatattataaatatagatatctttttgtaaaaaacattagaacataattttatattgaacaatcttatataatttttgtcctaaaataagatgatttactattttaagaagacaaatcaaaatgtcccaacaagtcttagtctatgtaaattataataaaatacatttgggaattatgtcccaacatatcttactctatgtaaattatagtaaaatacatttgggaattatttaataaaattaagtataattaacaggactataattttaaaaattatgtcttcctaaatattaaactttaatattgaaaatacacaaatacaaaactgaatattttgattttctatgtccaaacacagttttcttaatattaatttactctaaataaaagatttaaacattgatttttaattttaacatctatttctctttaaaacttctcaaaattacacttcaaaagttcaaattttgttaatattttcacacataatttacagacttttattgtcatacctttcaaaaaaatgtaatttttttacttcactgggacaataactcttttctttaacctttttttaaattattatactttaagttttagggtacatgtgcacaacgtgcaggtttgttacataggtatacatgtgctatgttggtttgctgcacccatcaattcctcatttatattaggtatttctcctaatgctatctctcccccagccccccacccccaaacaagccctggtgtgtgatgttccctgccctgtgtccatgtgttctccttgttcaactcccacttatgagtgagaacatgcggtgtttggttttctgtccttgtgacagtttgcttagaatgatggcttccagcttcatccatgtcactacaaaggacatgaactcatccttttttatggctgcatagtattccatggtgcatatatgccacattttcttaatccagtctatcagtgatggacatttgggttggttccaagtctttgctattgtgaatagtgccataataaacacacatgtgcatgtgtctttatagtagcatgattcataatcctttgggtacatacccagtaatgggatggctgagtcaaatggtatttctagttctagatccttgaggaatcaccacactgtcttccacaatggttgaactagtttacagtcccaccaacagtgtaaaagcgttcctatttctccacatcctctccagcatctgttgtttcctaactttttaatgatcaacattctaactggtgtgaaatggtatctcattgtggttttgatttgtatttatctgatgaccagtgatgatgagcattttttcatgtctgttggctgcataaatgtcttattttgagaagtgtttgttcatatcttttacccacttttcaatggggttgtttgctttttcttgtaaatttgtttaagttctttgtagattctggatattagccctttgtcaggtgggtagattgcaaagattttctcccattctgtaggttgcctgttcactctgataatagcttcttttgctgtgcagaagctctttagtttaattagatcccacttgtcaattttggcttttgttgccattgcttttggtattttagtcatgaagtctttgcccatgccaatgtcctgaatggtattgcctaggttttcttctagggttttttatggtgttaggtctttttttttttttttttctttgagacagagtctcgctctgtagcccaggctggagtacagtggtgtgatctcggctcactgcaagctccgcctcccgggttcctgcattctcttgcctcagcctcccaagtagctgggactacaggcacctgccactgcgcctggctaatttttttttgtattttttaatagagacgtggtttcaccgtgttacccaggatggtctcgatctcctgaccttgtgatctgcccgcctcggcctcccaaagtgctgggattacaggcgtgagccaccgtgcccggccatggtgttaggtcttcattcaagtctttaatccatcttgagttaatttttgtatactgtgtaaggaagacatccagtttcagctttctacatatggctagccagttttcccagcaccatttattaaagggggaatcctttcctcattgctttttttagtcaggtttgtcaaaaatcagatgattgtagatgcgtggtgttatttctgaggcctctgttctgttccattcgtctatatatatgttttggtaccagtaccatgctgttttggttactgtagacttgtagtatagtttgaagtcaggtagcatgatgcctccagctttgttctttttgcttaggattgtcttggctatgcaggctctttttaggttccatatgaactttaaagtagttttttccaattctgtgaagaaagtcagtggtagcttgatggggatagcattgaatctataaattaccttgggcagtatggccattttcatgatattggttattcttatctatgagcatggaatgttcttccatttgtttgtgtccccttttatttcatcgagcagtggtttgtagttctccttgaagaggtccttcacattccttgtaagttggattcctaggtattttattctctttgtattaattgtgagtgggagttcactcatgatttggctctctgttagtctactattggtgtataggaatgcttgtgatttttgcacattgattttgtatcctgtgaccttactgaagttgctaattagcttatggagattttgggctgagatgatggggttttccaaatatacaatcttgtcatctgcaaacggagacaatttgacttcgtcttttcccagttgaataccctttatttctttctcttgcctgattgctctagccagaacttccaacactgtgttgaataggagagggcatccttgtcttgtgctggttttcaaacagaatgcttccagtttttgcccattcagtatgatattggctgtgggtttgtcataaatagctcttattattttgagatatattccatcaatacctagtttattgagagtttttagcatgaagggctgttgaattttgtcgaaggccttttctgcatctattgaggtaatcatgtggtttttgtcgctggttctgtttatgtgatggattacatttattgatttgcatatgttgaaccagccttgcatcctagggatgaagctgacttgatcgtggtggataacctttttgatgtgctgttggatttggtttgccagtattttattgaggattttcgcatcaatgttcatcagggatattggcctaaaattctctttttttgttgtgtctctaccaggctttggtatcaagatgatgctagcctcctaaaatgagttagggaggattccctctttttctattgattgaaatagttttagaaggaatggtaccagctcctctttgtacctctggtagaattcggctgtgagtctgtctggtcctggactttttttggttggtaggctatcaattattgcctcaatttcagaacctgttattggtctattaagagattcagcctcttcctggtttagtcttgggagggtgtatgtgtccaggaatttatccatttcttctagattttctagttttcttgtgtagaggtgcttatagtattctgatggcagtttgtatttctgtgggatgggtggtgatatctcctttatcattttttgttgtgtctatttgattcttctctcttttcttctttattagtgttgctagcggtttatcaattttgttgatcttttcaaaaaaccagctcctggattcattgattttttgaagggttttttgtgtctctatctccttcagttctgctctgatcttagttatgtcttgccttctactagcttttgaatgtgtttgctcttgcttctctaattcttttaattgtgatgttagggtgtcgatttgagatctttcctgctttctcttgttggcatttagtgctataaatttccctctacacactgctttaaacgtgtcccagagattctagtacgttgtgtctttgttctcattggtttcaaataacgtctttatttctgccttcatttcgttatgtacccagtagtcattcaggagcaggtttttcagtttccatgtagttgagtggttttgagtgagtttcttaatcctgagttctagtttgattgcactgtggtccgagagacagttttttgtgatttcttttcttttacatttgctgaggagtgttttactaccaattatgtggtcaattttagaataagtgcgatgtggtgctgagaagaatgcatattctgttgatttggggtgtagagttctgtaggtgtctattaggtctgcatggtccagagctgagctcaagtcctggatatccttgttaaccttctgtctcattgatctgtctaatattgacagtaggatgttaaagccttccattattattgtgtgggagtctaagtctctttgtaggtctctaaggacttgctttatgaatctgggtgctcctgtattgggtgcatatatatttaggatagttagctcttcttgttgaattgatccctttactattatgtagtggctttctttgtctcttttgatctttgttggtttaaagtctgttttatcaaagactaggattgcaacccctgctttttttttgctttccatttgcttggtagatcttcctccatccctttattttgagcctatgtgtgtctttgcacatgagatgggtctcctggatacagcacactgatgggtctgactctttatccaatttgccagtctgtgtcttttaattggggcatttggcccatttacatttaaggttaatattgttgggtttgaatttcatcctgtcattatgatgttagctggttattttgcccgttaatgatgcagtttcttcatagcttcaatggtctttaccatttggcatgtttttgcagtggctggaacctgttgttcctttccatgtttagtacttccttcaggagctcttgtaaggcaggcctagtggtaacaaaatctctcagcatttgcttgcctgtaaaatattttatttctccttcacttattaagcttagtttggctggatatgagattctggtttgaaaattcttttctttaagaatattgaatattggcccccactctcttctggcttgtatggtttctgctgagagatccactgttagtctgatgggcttccatttgtaggtaacctgacctttctctctgggtgcttttaacattttttccttgatttcaaccttggtgaatctgacaattatgtgtcttgggattgctcttcttggggagtatctttgtggtgctctctgtatttcctgaatatgaatgttggcctgccttgctaggttgagtaagttctcctggataatatcctgaagagggttttttttttttgtttttttttttttggttttttttgagacagagtctcccactgtcacccaggttggagtgcagtggtgcgatcttggctcactgcaaactctgcctcctgggttcccaccattctcctgcctcagcctcccgagtagctgggactacaggcacccaccaccattcccggctaatttttcatattttttggtaaagacagggtttcatcatgttagccaggagggtcttgatctcctgacctcatggtctgcccacctcggccttccaaagatctgggattaggaggcatgagccaccgcacctggccctgaagagtgttttctaacttggttccattctccccgtcactctctggtacaacaatcaaacatatatttggtcttttcccgtagtcccatattttttggaggctttgttcatttcttttcactcttttttctctaatcttgtcttctttgtttatttcattaatttgatcttcaatcactgatatcgtttcttccacttgattgaatcggctattgaagcttgtgcatgcgtcacgaagttctcatgccatggttttcagctccatcaggtcatttaaggtcttctctacactgtttgttctagttagccattcgtctaacctttttcaaggtttttagcttccttgcgatgggttagaacatgctcctttagctcagagaagttcgttattaccgaccttctgaagcctacttctgtcaactcgtcaaactcattctctgtccagttttgttcccttgctggcgaggagctgtggtcctttggaggagaagaggcactctgttttttggaattttcagcttgtctgctctggtttctccccatctttatggttttatctacctttggtctttgatgttggtgacctacagatggggttttggtgtagatgtcctttctgttgatgttgatgccattcctttccgtttgttagttttccttctaacagtcagacccctcggctgcaggtctgttggagtttgctggaggtccactccagaccctgattgcctgggtatcaccagcataggctgcagatcagtaaatattgctacctgatacttcctctggaagcttcgtcccagaggggcaccgcctgtttgagacgtctgtcggcccctactgggaggtgtttcccagtcaggttacatgggtgtcagagacccgcttgaggaggcagtctgtccattctcagagctcgaacaccatgttgagagaaccactgctctcttcagagctgtcagacagggacgtttaagtctgcagaagctgtctgctgccttttgttctactatgccctcccccagaggtggaatctacagaggcagtaggccttgctgagctgtggtgggctctgcccagttcatgcttccctgcctctttgtttacactgtgagctactcaagcctcagcaatggcaggtgcccctccccccatcaagctgcagtgtcacaggttgatctcagactgctgcactagtagtgagcaaggctctgtgggcctgggacctgctgagccaggcaacgggagggtatctcctggtctgctggttgctaagactgtgggaaaagcgcagtatttggtcaggagtgtaccatttctcccagtacagtctgtcaggcttcccttggctaggaaaggggaatcccccgaccccttgtgcttcccgggtgaggtgacaccccaccatgcttcagctctttgggttgcacccactgtccaactagtcccaatgagatgaaccaggtacctcagttggaaatgcagaaatcacctgtcttctgcgtcgatctcactgggagctgcagaccagagctgttcctgtttggccatcttggaagagaccttccctgtgtattccgagccttctgcattctgccatcactgcagcctcctcatgttggatggacctgatatttttgcttttctagtaattcagaaatcctcagtggaaaggctgtttattaatatgagttatctccagacagggcaaaggtgtggtctatggatgctgtggattagcaatgaccaggctctcaggtgactccactcatgtgattttcacagaaagactgctgtctggccagtgagcagcacagggcactgtgagtcacactcagtgtctgcacagtgaaaacccaaaacttgccacccccccaaactccccagggctgggtagatggagtctgcactcactgacacagatttagcagctagatatggtcccagcacccccaccttcttccaagtcctgcgtgccagacaccccgacaacagctcccagatactgataaatccatggggagagttgggggtaggcagtgggagcaacacacttgcatccataacccctcctttgtgaggccactgaaggggataagagaggcctggagaagccactccagttctggacctcaggagggctgtgtccactgtgacctgggcacctattctcctgtgatattctatcatttctcaggtagggacaggtctcacgtcctggggaagccccctagcctgagttcttgccctgtgtttcactctcaccctttgtcctgattcctcacccacgatcatctttgcttgcaggttccctctctcagcctttgcttattcagctgccctccctctctgcacatctgagaaatgctataagacttccctgtaccccaagtagtggctgcattgttggaggctgtcacatattcttgtaccagcagaagtcacggagccttccccagtatctcctgagatactactcagactcaagtaagcaccaggactctggggtccccagtcacttctgtgaatccaaagatccctcgggcaatgtgcagggattctgcacatttctgagcagcctgagatcaagtccgactattactattttacatatcacagcaacagtggcactttcactgtgctccagacttacggggaagtgagattagaacctcccctgcattctctctgccttgtgcaggcaacaatacactgtctgggaccgagtgtggctcatcagtagcagctttgttgtttgtatttttcattcttcagtacagggtgggacctttctactggcctccattaatagtgagagtcaaacaagacagtctgtgggtgactccaaagtctaactcagggtttccttatgttagttagcttggactactcttggctcctccccagagatctcaacttctctggaattctccaggtgccacaagcactgatttcagtcttggccttgcacctcccctgagcagcttctgactctcctctcattacatctccatttatggcctgtcacccactcaatgtgttaaaaggtaaagcattttgcaaagtacttatcctgaactttagccccaaatccacccagcttccctagcccaggccagctctgcttcttatgaggctgatgagaggtacaagggctgcgacccttgctgagtccattcctgaaaatgcccccaataaagcctgattagcgccaatgccacaggacattgttctgtttcctttgcaggtggtgcccagtgaggaaagttcttcctcctgaatatgaatattttggagcatgaaacagctgagctgatctggggaggggaggcaaccccttgtgatggtggtcagattgcttggttgggattgtcacagaccatgtgataatgggattatattgcatatcacagatgcgctggaccctcaagtgtgctggggaactctggttaaagaatagaagtgatccctttgttcatattcactatgctggatgcccttttgagatccctgcaggacgctaaccctctgactgcggcagccttgccctttgatctgaagcttttatcatacattgtcctgctcaggggatttgggtggggcgttactcctatatatcatcacaagaaagggattctctggagactaaatgcaaactggaatatcccctggaggctgtccccctgattgggaaatatgaagagactaggggtgctcagtgtttaaaataaaacttcagagagtagagtctgagtgtaaacccttcaattccatttaatctctacaaatgtatataatgtcaaaacatagttatgtcatatatttacacatgtgcacacaaatctattaatacatgttcataagttcacatatatgctttatgttatacatatatgcatttatacatcaactgatgttattataatcatagttttacagactcaattttcctttgggtttttccacatttccccactttctttaacacttatttcttgaaaattttggtggctgcttactgagattttactaaaaaagagcttcagaatttcatttagagtagatcttgtggcaaattctattttttttgtctgaaaaaatggtattttttctcttttttatttttaaaacttatcttgaagcataatatgtaaagtgaaatttgcagatcttaattgtaaatttcagtgtgctttttatgaacacatatactcatgtgccccatgcgtactcacaacatttccattactgcagaattaaaacattttgttctagtcaatgaaattattccattacagaatagatatgtgtaccacatagaatgtgtacctgagacacacttcccctggggactccttataaagtgcggtgaattgtgtgtcttttttcccattgaggaggccaatgtggaaaactaaagactgagatgatgtagaaaactgccctgagagggaacctcactctgccctgaggtagggagccagcactggtcaaggccccggtggaggatggcacctctgttgggtccacctggcctctggtcacaggcacgatggacctgggcctgggcagcagggggcgctgtggggctggcacttagagtctgtggggctcttagctgggaaatgatacctggccctggcctctgcctagggctcactggggccagcagctgggtcctctctgggccctttgggagcctcagtccaggtacatcccaggcctactcttcccagaaatgacccagccactgggactgcacacgggcccagggaggggcacgcttgggcaggggaagaggagcacatttgcatgaaaggcccatctctctcctctaaggctagagggtgaacacgagagacctgccgcgtggcttcctctgcagagatccggggagtctgcaccatggccttgaccccactcctcctcctcattgtcctccttcactgcacagtccaggacggcacaaagcatcctgatcccccagctcactgacaccacctcccaactcatgccagaactgtccttccctgttctgctttattcagtgtataatggctgtctgtgttttcgggatccctctggcagcccgtgccgactcagtcgacctctgcatctgcctccctgggagccctggccaagctcgcccacactcagcagtcagcatagcagctatgccattgaatgctttcggcagcagccagggaaggcccatcagtacctgatggagcttaagagtgatggaagccacaccaagggggctgggattcccagtcactagttctcagtctccaggactggagctgaccactatagtgtcatttctacaatcccgtctgaggatggagctgactatatctgtggtacagattgtagcattggtgtgccgtttgggtaaagcacagataaatggggaaatgaggcaaaaactgtttttctactctgctaccaaggttgaaaaatggctctcagaaccagtgtctgctgacctgcatactcaaatatgttatgtgtgtgtgtgtgtgtgaatgcgtgtgtgtgtgtactttaattttacgagtagagagccagatattttctgattcctgcttccagttcccttggaaacagctttttaggccaggccttctagggagtgcactctgatctgtaactattgtgcaaatattacaacagagcctgtctcctcctgctggtctggtgtattgtggctatataggggggtgcaaagaaattctccttttcatattcagacactgggactcagctgcatacctcagtcctgtcttattgagatcatttaaatgatcaatcttagaagaaaacttctgacttaaataaattttagaagtctatcaacatgctagaaagcatattccagataaataaaaatagaataaagatttatagagattgagatgaaaagctttaaaccctttgggggtttctgaaggtattctcaggtgttcagtgcctgggatttgggagtaagggataaggaggagaacttatttccaacacactgaagatgacaacagataagcagaaagttaccaaagaaggaggaatagaaatagccatgaatatcatcctggtaaccctgatctggaatgaaggatttcatttatttacttatttatgtatttattttcaaaataagtacatctcatggagtccttggcaaaagctgaaggaagtattgcttcaggaaatatctgtccagtaattaggaaactactaatgtgattgagcagagacttcattaacttcacatgcaaagaatacagacttgcagaaccctcctggaaaaccatgaaacaatacatcatcaacaataacaactatagcaaaaacagcaacaacatcaaccaaaacgctttacaaaaaagttctaatttccagaactgtcacattatattatttaaaatttccatttgtcaaagcaaaataatgaggtaggttcaagacacaggaacatattgccatatataacggaaaataacaaagaaaaaaacattaaaaaaacaaaaaaattaaaagttgacaaaaactattttcaaagaggcagaaacactggtcttattcgaccaatacttcaactccattatttctccatttgctcaaagaaattttaaaaatgtaaaaatgttcaaaaaagcatgaaaagaatgtatctccaaataaagaatattaataaaagatataaaagaaagagtcattgaaataaacatagattaattgatattatcctattacaggaatagaatgaaataagggtggaaaaatacgcaggacctaaagaccctcttgacaccatcaagtgtaccaatatacacataatgaaaggcccagaagggtaagagtgaggaaaagaaacagaataatgtaattgaaaaatggtaaccaaaactttcccaaatttgacaaaaagaaacatactcaatccctaaaaagttcaataaaccttaatcagcattaatcggaactcatagatataaaacttatggaaagcgtcatggtgggataaagcttactaagttctaaaaagtcaaatagacaaagacggttacaccaaaagtgtgtcaatttctgtttcctgccatgatgcaatagatggagttcttacaccataaacaacactttaagacataatcgagtgcatgtaatgactatttccagacagtgaatattggccaacagggataacttgattatgtaacctcagagaaaggaccctaacacgcaaatgagcactgcagtggacacggatttctttttcttcactttttttttttcgagttagggtcctgctctgtcgcccaggctggagtacagtgatgtgatctccgctcactgcaaactctgcctcccaggttcaagcaattctcctgactcagcctcccgaatagctgagattataggcactcaccaccatgcccagctaatttttttgtccttttagtagagagggggtttcgccatgttggtcaggctggtcttaaactcctgactgatctgcccacctcggcctcccaaagtgctgggattacaggtgtgagccactgcacccagccaacacagattttttttttttaattatactttaagttttagggtacatgtgcacaacgtgcaggtctattacatatgtatacatgtgccatgttggtgtgctgcacccattaactcgtcatttaagtatatcttttttttttttttttagacggagtctcgctctgttgcccaggctggagtgcactggctctatctcggctcactgcaagctccgcctcccgggttcacgtcattctcccgcctcagcctcccgagtagctgggactacaggagcccgccaccacacctggctgattttttgtatttttttagtagagacggggtttcactgtgttaaccaggatggtctcaatttcctgacctcgtgatccgcccgcctcggcctcccaaagtgctgggattacaggcgtgagccaccgcgcctggaccacagatttttttttggagacaatttttggcccagaaggaggtggtgaccaagataatcgtgagctttttacacagctcagaacacacagatgagaagtcagaaaaacatagatggctgagactttcagagcaagacactgaaaagcaggcagctacacagagcaaggtccctgcgctctgcatgaggcccctttggatttggttgggcaaaacatgacaccttgcagggggctctaatttaatgaataggccttcccctactgggaactaagattcatattttttctctctgtcctgttttttcaccactgtatctacaaaccctaggactcagcctagcgcaaagagccaattaataccatgtttgttgaacgaatatgtgaattcacctaaatagaattctcagtaagagaaaaagatctgaggaaaataaagtgatttttactgctttatgtgtattttgagtttgggttgtgaattgattcaaggggatatattaaattagaatgttgacctccgtgtttagagaacaagagaggaatatgaacttgagtgctggaaaggtgaccagcaggatggactgggtcccatgggtttgtgcagagaccatggaaaaggatgagcctccagttactaagtaattgaacaagatatattttaggtaaacacttattttataatcacctgttggaatgggtgataactgtagatgtgactgttattcattgactctctgaaaaaattatttattcaaggcaagaaagattggagaatagttttatcttgaaacacttttcataaacatgacatattcttgctaaagcagataccatattcatctccaagctggaagggttatctcatcttcccaaacatgcaccccttatagtatattttatctgcttttatggcatgtccactttcttggtcacagacattgtaagcctcagagtttaatttgtttctctactgtatacgtatggcacctccagttggtcactgaagctggagattgaaatcctctacatcccccagatctgtcctctggctctatggcgctgtcctgttccatcagacctacattgcccttccttgtgtgaaccctaacctaagtccaatctctactccatgaaagctgtctgtaacagaagcctggcacctctttctcctttttatgaaataaatatctatttctatagatagatctagatctagacattaatagctccaaatctgtagaggacaaagtgcctagttctcaggtgataaccaacccacatcttctgtcctggaatatccagccccagatatcaccccattttctcctccctgtctcgctaaatatatattcacccaccaagccactgggtttgtagtaatttgtcacaacaagaacagaaaaatatgtggaaaagaatggaagaggagtgttgctgttaaaaaaaatacttaaaatatggaaatagttttggaagcagacaagagatagagtttggcagaattttggaaagcatgttagaaaaatcctagattgctttgagcatggtgttaatgcagatatggttgctaaagacttggctgggatgggctcagtaggaagtcagaagcatggtagcgaaaaagctacattttctttcttttttttctttctttttttttttttgagacagggtcttgctgtgttgcccaggctgcattgcagtggtacaatcttggctcactgcagcctccacctcctgggttcaagcgatttttgtgcctcagcctcccaagtagctgggactacaggtgtgcgccaccatgcccggctaaggttcgtaattttagtagagatggggtttcaccatgttgtccaggctagtctccaactcctgacttcaaatgatctgcctgcctcagcctcccaaagtgctgggattacaggcatcagccactgtgcctggtctagttacatttttcttagcaaatacctaattatacatctacagactggaagtagaaatacagccagtaccagcactttgggagaccaaggagggcagatcataaggtcaggagatcgagaccatcctggccaacatggtgaaaacttgtctctaccaaaatacaaaaaaatttagccaggtgtggtggtgcatgcctgcagtccaagctactcaggaggctgaggcaggggaatcacttgaacctgggaggtggaggttgcagtaagcccagacagatcacaccactgccctccagcctggtgacagagtgagactccatctcaaaaaaaaaaaaaaaaaaaaaaagaaagaaagaaaagaagataaaagaaatacatccagtaaaggagctcctggtgcactgatgggagttcacagggaattaagagcgctcttttgacttttgtgggaaaaccggaggaaaggggatcattgttttttggtggaaaacaggttggctggattgtttcatgcaattgtatggaaagcagaacaggtgagcagcaaacttggatatttagctgagaatatttccaagcaaagtattaaaagtataacctcattcattcttgctgcttacagtaaaattttgtgataaaaaatgtgaagtaagggaggaagtcttaaatggaaagaaactagggcatgataattgaggagattactagcatatttcgccaattacttgctcattccctcttttctgggagaccctaaaagtaactcatcatttactgttttccatccgcttccttccttgtctagaatatgggcctggaccctccacaagatgcgtagagaagtcagaaggccttgtcctgtgcaagcattcaagcatccactcctcgcactaatatttctagacagcaaactggtgatccttgctcacctgaaacatacatacgggttggaggaagacagaacctaacacaccttacctgtgtgatgttcagggctggcctctaacttctgagagcttcatttcactccacttcctacaaggattgctcatgccctccttcacttgtggtgaagttcaaacaatacattagatttgacatctttgccaagagctgtagagtgcaaggtgctcacccagagctacatcttccagcagatgaggctcacagttaaatcactgctatggtgtccgtcaactcaggcactgttgtgccttttcacagagcatcgcctgttaactgcttcacccacccactgtgggagtccaggtaggaggacaatgcctccccactagctggctcctctctggttgtacctgtgggtcacacatgcaggtgacggtttgtactacctcctacctggctgtactccccaaagccagggctgacacccctcactgcacttccattccatcccatcagtcacaggaggcagctattggctcattaccctttgcaaggagttcaagggtagaagtggcccatttataagaatatttatatggactatcttgtatatcctgtgaatcatgatactgttaaatcaactctaatacatcatgtttatgtccactgaaatgatgatgataaaaggaaaagtgatatctggacacgcagactgaaaaagatcccaaagattctgcacacaaggcccctattctctggggacatgtgggaattcaatggtcttgctgacatatagagtttgcttcactctgtgtcaatctgaggcatttgtgacctcagagttgtgttttctaagaatttaccatgtgtggcagctggacttcaagttatacctaaatatctctgtctcctagcactcacatccctgtacatattgaaaagggatcactagtacaattgataggatattgagaaaatgactgatgccaggccataatacactttgagttttgcgttctgctctctcagatcacttgctttggggaaagccagttgccatttgtgaggacactcaagtagtcccacagggagtttcatgcagcaagaagctgaggcctcctgccaccagctttgtggctcagtgaaactgtaagttgattctattgccttggtaaagtcttctcatggctttagttccccccactgaaatcctattttcaacctcatgagcctatctgagccagagccaccttgctaaactgctcccaggtttctgacccacagaaactgtgggattgcacatctttgcagttgctaagttttgtagtatttgatgtgaagtaattgaaactggatgcatcgagagaggggaatggaggtggcagagtgggtggaattaggcctggaggtctgctttcagtgagatgtgatgggaccatggcagacacctccctgtttctgattccagtggattgcttactgggcctggcctttttcttatactccatgacttcattgttaataccctacaggaattctgtatgcgctatgtcttatccatcttccttgggtaaatatttaaatataaatgaatcaaaacacatgggccactttctaatcttgattgttcaaaactgaattcctcaaattgaggggtatgattttctttattgtccttggtgctcgtctgccagtgtctatcaatggtagaatcatgtaaacagtcccctcccctattttgtttcactctctgaggacgagagagaagtcttggccttcaacagaaaatggtcaaactagaaagagtaacacttttgagctcctcagtgaatgtggccttggaaaaccccttcacctgggcagcaaaggaagagggagaaagacagagcctgaactggtaggaagtcctacctcaaaaacatcagtcagtcctcacatggatggccagggcattaaggagaactaattaagttaatttcacattctccatgacaaatgctgttgtcatcagtagggacctctcctctctttttccatcctcctacctgttctcactgtccctgacttacccacagtgaactttatgttttcaccttttatatccctatgcctggtcctctgctggcctgtgctgatcttttcataaatatttttgaaatgagaagacgcattttcttaagtaccatgaaagtcgacatcacatccatctttcagggtcctgctcccagactcttctgacttatctgttcactgtgctgggttggcagggaaaagtcatctgcagcagaaaaagtgacaaaatggagatacatagtgtgtcttggccaaaaatcagccaacagatgagagagatctaggattgtgagaagttctgccgttccccagcacctcacactatttgatgtctcaatgtttgtacatatcactatattttctagaagatgcactacatctagaaatagtgtttgctttgtttgtccccaagcaggaccccactctccactcagagccagttcacagttgccttcttccctggcccctgtggaaggagctgctcaggtgtttgctcccagagccctccgcattttccccttactgcggcctcctcacaatgaacaattgtcatgtttttcatttctcctgttcctgttattctagaaatccctcaatcaaaaaggatggttatgaatataagttacctgagacagagcaggggtgtggtccatggatgctgtgacctgacagggacccagcactcaggccaactccactcacatgattctgactgaaagactgaagtgtgcagcagggggaaatctgggtctttccaagctctgaacagtggtgcccacatatctgttatccctgggcaatggagcctgcactcactgaggaagataccacagctgtgtcttctctgggctgggtagagtctcctactcacaggtctgtggaaggtgcaggagctgcttcctcacttactcctcccgtgggacaaacgctgagtctcacccaccaacccaccatatctaaagaatcatgctcagacttcagctcttcctagggtggaacaaagattaccaggaggatacacaaatttgtgtggacagatcctcccttttcaggccactggagaagataaaagaggcctgagttaagcagcttcctctgtggggccacaggaggcggtgtccaccatggcctggacccctctgctcctcatgttcctctctcattgctcaggtgagaactggttttaggtgtctagggttagctccttagcttgcgtcagcctctctggctcagatccccaagacatgtatctctagttcctgccccagcccccatgagtgtctgtgcttgcaggttccctctcccagcctgtgctgactcagatgacctcactctctgcatctccgggagcatgagccagacttacctgcaccctgagcagtggcttcagagttggtaactttgcaatatagtggtcagctgaagccaggcagccgtcccaggtgtctcctgagatactactcagactcaaatatcactcagcaccctggggttcccatccacttctctggatccaatgatacattagccaatgcagggattctgtacattcctgggctgaagcctgagggtgaggctattactgttgtacgtgtcacagcagctccaagtcagcactccagacccactgggaggttacaaaaacctcttctctgatctcctggcctggtgtagtcactcctgctggtggctctaataaagtctatctcactgggtgacttatattttagatcttcaaccagcacctgattctttttttcagacaagtagatctgaaaatgtgactttattttcttcaattccactttcatattgattcatgctcataccttctcatttctttctggttttcacaggcagaaatcccttgctcagagacaaaaattctctaaattgagactttggaggagaccaaaagagagtggttcgggccatgcccggctcagagtctaggagtgactcagagatgcttctggtcccagagcttcaatctaggcattggatacaataccagcattcacaatggaattgtattctctatattagcaacaaaccatcacagattttgaaataaaaagaatataatttataataacatcaatataaaatatttaagggtaaatattaaaaaatggaaagtcttaaactgaaaactataaaacgttgagagtcattacaaaaaaaccttaaaataactgatattccttgtttgtagttggaaaactcaatgtgattataatttttataatgacaattctttccaaagttatctaaggaatcattgtaaggtcttcagtaaaaataggtttgcagggaatgaggagataaaaaaatctcaacaaagaaatgaaaactgtaacagaaaacatcaatgaaacaacagacctgggataatccttctcagctgccatgggatctaactgtatttaagaaaggggtgagtaggaaggcggctgccaaatccaggaacacagatgtcattttgagtgaccaaggtgagccaagggaggacagctttagtcagaagagcatagaccaggagcagaactcacatatctgaagctgatgggcagagtgtgggtgcaataggcctggcattgggtgctgctgagctgaaattatgctgtcacctgaggtgcgcccctggggtgacatggttctggttgttcttcaccccagggaaggacactgtgacctgttatctgttggaggatgaggactcagaaagctctttataagagagggcaccagtgtgatatgagggtccctgattgtctttccaaaggttggaaattgaacccgcatctttcatttttgtgtagagaacccaagatccttttctacataatcaagggttatttccaatagctgccttggcctgtctcagaaagagtgtgggtttgtcttacagcaatggtgcccactatttatgggaacgtcttgtataccctgatctatgctttcaggtctttgacatctcaggtttttggcctacctaatactagccatacgtctgggtactgtgatctacctcctactacacatataaatgcccatctcagcctcatctctccttgggatataaatgtgtgcaagggatttgaagcagctctgccttctttttgggtcctaaggatcagggttatgggtgtctccatccttccctgggtcttctcctcctcactgtcctgaaacatgacccagacacaggctcctgaggctcctgcaggccttcttccctgcttttgccaactgcaggtggaccctgccctgtgctcacaggtctttgtatctctccctgctggtcaattgccctgcaggggcttttcttatttctccattatgagaattcctttgtttttggaggaaataatttttatctaatttttgatttacttatcataatcctagaatttgtataaaaactcctgtttttgcataatgaaacagttgctatctcatgccattttattcaaagtcatgtgcttctgttcacttactggttagaactattgtttaatcattgacaaatatttatcgaacacccactctgcgccatgttctcctatgtcaggtgctgggtatacattgatgaatgaaacagactctatccttatggaacttgtgtctagtgagcttagaagtaaattttgtgagtgctaggatggagagtcaagctaaggactcttagttctgccagcatttaacatgttgttcttatacattttaagaataaattactccagaagaatctttttgttttgttttgttttgttttgttttggtgaagagtatccacatagacacacatagcaaagaccttatagaatgcatcagagataaacaaaataaaatgtaatgtttcccagagctggatgtagtttctggtttgatttattttaatgacacacagaagaaatcactttataatgaagtaaaattccacactacagaaacagagtaaaaatactttcttgaaaaaaatgccaaacctacctttaatcccaaggaaagagaattgcttgaatagatctgttagtatgaaacacataatagacaacctgctgtgtaaaattacttggaagtcatattttagaaggttttaaacattcttaatatactctgtttttgatattacgtcttatatttttctctgtggtggaaatttatttctaagaaataagaaaggatattagaatggcaaaaaatatttgtataaatgtgttaacattttaatggtaactatatatgaataaaataaaaacattgttaaaaatttattggaatgaataataaaattatcaagtttataattaataaaatcaagtatatttcttcttatgcaatttaaaaatagtgcagaatgtttattattctggtatcactaaaaatgacaaacttcattcatatctatagaaaaataattataaaattcagcaagtaatacaggagataatttgaacaaatattgaaacattttcttacttaaagacactaggtaaaaatttcagcaatgagtagagaggttatcaaggcgcattttattattgatgattgatatatgttttttctctcgagaaagtgcacaggtgggtatcagcagaggagacagtataggctccccagatgtcaaagcagggatgcgccaatacccatcagtcatcatcataaaagacagactgtgccttcctgtgtcaggctctgtgccaggagctgtgtgccccacgttcccttccagggtcctgcctgaagtctgtgctcactcagccagccccatcatctggaagtaacagtcccctcctcctgcactggaataagcagaagatttgggtggacagtgtggcctggccccatcagctcccaggagaagctctctgtctctctctcatcctgcatgccagttaatgacgataaaacccacctaaccaacccatctacaacactcagcttcatccctatctctctctcacactccatcaagggacacagtcatcccatgggttttttcccctggcatctctcactttcttcctcttccagatccctgggatcagctatcaccccacccgacaccccttctcctgcttggctgccttcaggctctttgttgagcctgacaccaaaggatgtctttctaaagtgtcagtttcatctattctgcccccagttcacaacctgaaacaacctccgatagtgaatcaagccaagcccctcactctaaagcacagagacatgccatgaattcctaaggggatgacagaatacatcattgatgagaagattgaacaagtgaagtgtgagtggcaagtcaggtgaggacatttgaatccaatctggcatttaaaatgtctcttcatttccaaagtcctatctctccctagtaatgttgtttgactgctagtcccagagcaggaccccacatcccagtgacagccaagtcacagtcgcctccttccctggcccctgtggaaagagctgctcagggctttgctcccagagccctctgcattcccaacttcctgcagcctcctttcattggatgggggtgatagtttgcacatgcctttctagtaatccaagaaaaacttactgaaaaagtctgtttgttcatgtcagtaatcaggggcatgaccagggcatggcccataaatgcctctggactgatactcaccaggctcccaggccaacaccacatacatgatttccactgagagaatgcagtctggacagagagcagcagggtacactgtaggtctgcccagtgggcatccacagctgtgccaacccctcccaccccacaaattcctcagggctgggcagtggaccctgccctcactgagcctgactcagcagctctgtcctccctgggtgtggtcccagcacccacttcctcccaggtctggcctgccagactcccccctccaccagaccctaggacttgaataaatacatagggtaaggtagaggcaggcaatgtgggggacacatttgggtccataactcctcctctgtgaggtcagtggaggggataagaggcctgaggcagcccactatggctgtggacctcaggaggactgtgttgaccatggcctgggcccctctcctgctgtttctctctcaattctcaggtaggcacaggcctcccatgtccagggcatgtccctcaggcttcaccagtcccctctggctaaaatcttacagcaactttatgctggtaggtggcccaactcccatgtgcatctgtgtctgcaggttccctctcccagcctgtgctgactcagccgccctccctctctgcacctccggatcagccagactctcctgcaccctgagcagtggcttcagtgctgatttctgctggatatactggtaccagcataaaccagggagcctccccagtatctcctgagccactaccaaaattcacttcatgaccagggctccggggtccccaggcacttctctggattaatggaaggccggtccaataaagggctcttgctcatatctgatctccagtctgaggatgaggcttactattactgtatgatcgagcacagcagagcttctcatgctgacacacacaggtggggaagtgggacaaaatctcagcctgctcagagtcttgttctctgatgaaatttagatcttaaaataacttatatcacttgtgtgggatgagtgagatatcccgagctcacaggaactgtcgatgaaaagagtcgagctctgtaaaatattgaagacatttattccaagccaaatatcagtgaccaatggcccacaacgcagccctcaggagatcctgagaacatgtaccccaggtggtcaggctgcaacttggttttatacattttaaggagacatgagacatcaatcaacacatgcgagatgtacgttggttgagtccaggaaggcagcacaactcaaagtagtggggctccaaagatcgtctttttgataattggttaaaagagttaaattattgtctaaagacttagaaccaaaggaatgcctgggttaaattaaggcattgtagtgaccaaggttttgttgctcagaggaagcctccaggtagcaggctgcagagaaaatagattgtaaatctttcttatcagatgtaaaaagtctgttctctcagaaattccaaaaatgaggaggcatatctggctccccgttcccatgatgacctgaactctctttcagattaactttggaatgcccttggccaaaaggaggggtctgttcagatggatgggagtcttagaattttatttttggtttacaatcctgtaacacgtcctgtaatttgctgcccagaggtcattaatggcctggaagaaataatgtgccagctgcagtgttgtccacagaaagacttactcattctgctgccctgagtagtgatatcagaaagatccatctgccaacagtcagaatacccttccaggagggttgcacagtaccaggggtgctggaagacctgggatctgaggcaagcagggggcactgttggatggatcccaagatgacaggattaccaggccacacaaggattaaacaagagacagtaacagtccactggctcttacacacttggataagcagtgacctccctgaagaatgactttcctgcacctgggctgaaggacccacatgagcactgggttttggataaaatagagcaatttcatttatgaacatagatgtgaaaattcctcagcatattcacaagtagaacccatgctggacctctgacctctaggatttaggctgagaacaggacatttgtgaggtcggtggggaataagcatgaactttggagggacagcaggtatgaggggtgctgagccgtatgttagatgccccaatcagggaaagagcctcgaggcttccagtgcagcttccctgataccctgtgggagagaaagatagatactggatatgctgcaatagagctcactaatgctctagtaaagagcaggcagcttgcattagcacagtccttcaggagagaaaacgcagccccaggaaagctgtcagaggccaagatgactcattagtcacattgaattcataatgcatttatgatgaaatatatgataaatgtcttatccttttgttcttttttattttttattatcgtgggtacataataggtgtatatatttatggggttatgagatgttttgatacaggcatgcaatgtgaaataattatatcatgaagaatggggtatccatcctctcaagcatttatcatttgtgttacaaatgatccaattacactctttacataattcaaaaaagtacaattaaattattatgaccataggtatcctgttgtgctatgaaatagtaggtactattcattctttctaactactttttgtacccattaaccatccccacatcacctcctactccctgctaccttcccagcctctggtaaccattattctactttctatgtacatgagtttcaaatgttttgatttttagattccataaaaaagtgagaatatgtgatgtttgcctttctgggcctggcttattacacttaatataatgatctccagttccatccctgttgttgcaaatgacagactcttattctattttatggctgaatagtactccatcgtgtgtatttaccacattttttatgcattcatctgttgatggacacttagattgcttccaaatcttagctaaacagtgctgcagcaaacataggagtgcagctatttctctgatatactgattttctttattttggatatgtatccagcagtgaaattgctggatcatatggtagccctatttttaggttttttgaggaacctccaatcgttctccatagtggctgtactaaatccaagaacattcaaaatcatatttatatcagtgctaaaaagtgtgacttgacttcaaacaatagccagtagttggtaggaatacaagtataagtttgctaaaaatatgatttgtcatttatatgaatatttctgttcccagaacaatctcatgtagactggcttctggaatctctcctacctcctactgagctgactctcctggagcctggccgtaacggtgcagggctggaagctatatactacaagcacatgctgtatggcatccagcactaacctgggcagatgacggcgaaacaatgtgtgatatttccatttgatttattttccttctttctctatagaaagtgttattataaaactgttatgttgaaggaacacaaaatttgaaggaaaggaatcaaacataaatgttaaatgtttatgtgtgtttatactgttgatctatgatatctcttgtagttactgttcaacatttctattttatatgcttttgtaaaataaacaacatattttatacaaaaactctcatgtgtgctagttgaaagtaatgccacctaaatgcaataacagaatttgaggagactaaaatgtgttgatttgagagacagtaagagtaatttagaacaagtccccatctggctctgaaatctaatcctttgctggtatccctacacctgaaaacctgcaggctttgcacctctgcagacagatgacattgggttaaattcatgggtctccactgagggtcacaataggctggtgtggcacagtgcattctgggagatacagaactgagggacagtaggctgggcgcggtggctcacacctgtaatcccagcactttggcaggccgaggcgggcagaacacgaggtcaggagatcgagaccatcctggctaacacggtgagaccctgtctctactaaaaatacaaaaaattagcctgacgtggttggggggcacctgtagtcccagctacttgggaggctgaggcaggagaatagcatgaacctgggaggaagaggttgcagtgagccgagattgtgccactgcacttcagcctgggcgacagagcaagactctgtctcaaaaaaacaaaaacagacaaacaaacaaagaactgagggacagtatatccccagtggacaccgatccataatcagccccagtcactgcacagactgggtgtatggtgtcctcagtgcctgctgcttccgtgtaaatgaacagcaggagatcctagggtattagtgaattatatattcatttccaacgtcacactcaagatgaagtctctacagtatttgaaattgaacttggacagcttcaactatttttgtttcaaaaaatattatatatacaaaaataccctatttctgaaggtaattggagtttattttacttccacaataatactaaacataaatggttagcgtattataaagtggtgtgtctaggcatggacagcagaaggcacttggagcctgttcctgaggggtctgggggtgttcggagctgagaccagccacttcccctgtctggtgctctctgttcagggctcacagctgtgatctcctcacccctgaacggctcacagcactactcatacttatccctatggcgccctcaggcagaagagtctgatccagggctcagggtgggatcagaaaagttcccatttgcatgaggagatcctccctgcctcagagtataaagagagaaaaggagagagttgggaaaagctttacttcaactgtggggcaaaaaggcaggactcaggacaatctcaagaatggcctggtcccatttcctgctcaccccctttattcactgcacaggtgactggacatggggccacggaaggggccctggggagcccatggagagctgctttctcctcttatttatagacccagaatcaccatgtctgtgtctttcccactttcagggccttgggtcccatctgcgctgattcagtcaccctcagtccctggggctctgggccagagggtcaccatctcctgcactggaagcagctccactttggttattggtgtgatatacactggttccagcagctccaaggaatgacccccaaactcctcatctataaaaacaattggtgacacctgtgggtccctgacaattctctggcttcaagtctggcaactccattttcgtgaccatcactgtgctacagcctgaagatgaggctgattatcactgccaattctacaaaaacagcctgagtgctttcacagtgctccgggttgaagtaagtcagaccaaaacacacagtgtgcccagccatgaagctctcccatgcaccccctactctgcagctaagtcaatgtgttctctcacttgtttgtcctaaaactggggcctgagaacttcttcagggtaatttttctagggaatgtgtcctcaccctctcaatatctgccccaaattcactctttggcaacaataccatgtgctcttttctcagaggtagcagctggtactgaatgccagaggccagctgccctgtggtggagtacagatgggtgaatcagtcggctggggcttccacaacaacacaccacagactggagtcttcaccaacagatatgtattgtcttactgttctggagtctgaaaggaccagatgaaggtgccaccccgtttggttttctctttgccctctttcctttgcttccagatggctcttttctcactgtgtcctcacatggccacccccaggtctgcatgtggtttttgtacacatttcttatgaagtctttagtccttttggattagagactcattcctatgacttcattgaatcttaataatcttagtgtccagatctcccaatacagacaaattggtaacttagttataacataaaaaatcagggggccaggctcggtggctcacttctgttaatcccagcactttgggaggctgaggtgggtggatcacgaggtcaggagattgagaccatcctggctaacacggtgaaactccatctttactaaaaatacaaaaaattagctgagcatggtggtacatgcctgtagtcccagctactcaggaggctgaggcaggagaatcactggaaccaggaggtagaggctgcagtgagccaagatcacccactgcactccagcctgtgtgacagagcaagactccatctcaaaaaaaaaaaaaaaaattcggggtggatgcaatataatttgtaacaaaggatcaggggtccagggacccagagtccatctgtgtctgacccaggagaggtgatgctgcagaggccacctggtcactccattcctctgagctcctactatgtgcagattctggatgtgttcttggtgctcagggtacagcgtggataagacaggatggtccctgtcctccaggaactgatgctatttaggggaaaacagaacacatcagtaaatgtatcaataagaatatgacatgttttaggaaaatgaagagaggtgtgttttggtgaggtggggtgagcagacttagaggagttgatgacaaagatgcagcgactgattaaggttgtaaaattcacctgctgcaacataaagtgaactaagaggaagtgagggtccaggcagggccatatgaggctctggttttgacacaaacattaggctgtggagtcctggacatgggcggaacacgcaaacggtgaaaggtcatgtctgcatggttcagaagtgggaggtgctgaggaatggagtgtggggagacagggaccacagctgggatctcaggacctgtgaggggtataggtgagctgcagctaagtgagaaaacattaaggaccctgtgtagttgacacaagattattgacatcttaagtcttcaataaatacaatcagcgctgacaaatgtggccgtgcctcagaagagctagaaatgtttatgtctaggtaactctcatgttctgtagaacttcacttgtatttttttggttttaaaggattattataagagcagacgtttatgaatatactccattcttttatcctcaatattgcccatctcttaaaatcctttggctttacacacacctacaacaaactgatcttcaaaaattgataaaaataaacgatgtgtaaaggataccctattcaataaatgatgctgagaaaactggcctacaatgcagaaaagtaaaactggacccctacctcttaccatataaaaaattaattccagatgaatgaagacttaaatgtaagacctccaactattaaaatcttagaagaaaagttggaaaatactcttgtggacattggtgtgggcaaataatgtatgtctaatcatcaaaagaaattgcaacaaaaaacttgacaatcaggaccaaataaaactaaggagctcctgcatggcaaaagaaactctcatcagagtaaacagacagcctacgcaatgggaaaaatatttgcaaactatgcatctaacaaaggactaatatccagaatctataagaaagctaagtcaacaaaaaaatttaactccattaaaaagtggacaaaggacatggtcacttctcaaaagaagacaaaaaagcagccagcaaacatgaaaacatgcagaacttcacttatcagagaggtgcaaatcaaaaccacatgggatatcatctcataccagtgagaatgggtattattaaaaagtctaaaaataacagatgctggcaagaatacagaaaaaaaggaatgcttatacattgttggtggggatgtaaattagtacagcttctgtggaaagcagtttggagatttctcaaaaaaaaaaaaaaaaaaaaaaaactaccactggacccaggaatctaggtgtgtacacagaagaatataaataattctaccaaaaagatatctgaactcattcgtttgttgcagcagtattcacaatagcaataacatggaatcaactcaagtgctcattagtagtggatcgagtaaaaataaaatgtgtgatacgcattcaccatggaatactatgcagccattgtgaacaacaaaaccatgttctttgcaaaatatggatgtagctgaaagctactttgcttccagatggctctcttctcactgtgtcctcacgtggtcactctcaggtctgtgtgttgtttttgtacagattgcttatgaagtcattagtcctcttggattagagactcattcttatgacctcattgtatcttaattatcttagtgtccagatctcccaatacagataaattgttaattcagttataacgtgaaaattcagggtgaacacaatataatttgtaacaaaggatcagggatctctttggcttctcgatggatcacctgccaaggggcaagggtgtaatttttacaatgataggcgcatagctcttaacacaagacagaattaccctgttgaatgcttcattcaaatgatatgttagggaggaggccagttggatgataaagctttgggaatgaacatttaacagcacaggatctaaaatgcagaagaaaagaacctctgatgcaaactttctgagtggagataaactgtctgatatcctgcagattaataaaaccagaaacttcatctgccccctctaatagaaatctacacattaacacaatttcactatatgaagtttccagaagatgatgtggagcttgcaggtgagcttcattttacactttccgcctattcatttctgtgggaggacttactttccctctttcaattttctcatgtgctgttcatgtcacaccctctaattcaaggctccagcccacctttcctgccaacaccaacactctctgtagatgaaaacccaccagtcagcagcctccttggcctgagagaggtcatcttcctgggtttctaagactctggtcctgccgagattctccttcctcaatcctaatcccgtggtctctggcagccccttcacatggacctcatcgctcgtctctgtgttcctccagctatatccacgtcagaaactgctcttcatctgcactagaaataaagaattatcctctcaactcttaaatgtttgctctgattctctcctcttctttgagctcaggcacaccaccccctctcagattcctgagtgtggcagtgtcccctctccagtctccctaccacctccaatggtgaaggcgaagaaaggatgtccctgcatgtatcacatcctcatccttcccttcagggtcagctccctgggtagggaaaacactgttcccttgaggctcacatacccactgtcaaaaagcacccagcacatggtaggcactcaataaacctttaccaaatgcagacctgcctctcaccacactggacacattgtagtgagctcaggatggggctaaactgggagtattagctgtaaacttgctcctctctctgtccccagcctgagagctgagggggcacccacgagggagagcacctaggggcagggaggggtcacaggcagcctcatcctctgtgtgagacactgctcagactgggggatccctcttcattcagatgggaagaaaagggaaacaaaattcggtaggaacttctatgcatccacacagaggaggcaatgacaagaaaacacaggatgcaagcacagtggtaataatgtatttctacctaatattgaataaaactcaatattgcctgtattctgtaaacaataactatttacaaaactgactgtaaattatgattttaaaaaccacagcttatgaagaagagaaacctcaaacaatgacacccctgaattgcaaatctaagacatggcacacatttattttcagttccatatgtggcctggatttatttacaagacaatattatgatattatatgtcactattccattttagatggtgtatttaaaatctcacagtactgcaactacctagtaatctactcatcagtataaacatcaatgtgacaatcctgctatccttctctacccctgcataaccccagcaaaaattcattatgaattcacagaatgtaatatcagaactgttgtagccacatacacagtttgtttcattttatgttttgataaagtaatcttttttgtttaagcttattgttttttaaaaaatatattacatactagatgtcattacaaatcagagattaataatttctcttatgcttatactactcccacagcactcattactgaatgtaaaccatatttatattttctttctttttttttttttgagacagggactcactctatcacccaggctggagtgcagtcgcacaatctcggctcattgtaacctccacctcccaagtttaattgattctcctgcctcagcattctgagtagctggcattacaggcacccgccaccatgcccagctaatttttgtatttttagtagcgatggggtttcaccatgttggccaggctggtctcgaactcctgacctcaagtgatctgcctgcctcagcctcccaaagtgctgagattacaggcttgagccacctgcctggctccatatttatattttctaaacatcctacttggagtggctgatcctaccagctaccatgtttccacctcacctgggatcaaacactgacaattggtaattttatctcttgcagtcttcaaatattgagcaaatttgccatttttgctattcaataaaaatgctggaaagttatttgccatgccactgactctgttcagtgcttggaggacagactcctaggagtgagaagttgaccacagcatctgaatagctattaccccaagtctgtggaaattagagaacaaaattttaccagaaatgccccccagagcttctccccataacctcaccacccttagagaagagagctcctgttctcctcagcgctgcagggtccacagaggaggaagagctctggccagcagggaggagccacagaagaaaggacctggtgtctcccgtgaccagggtagtgagtcatgggaaccagtcactgctctggacttgacctgacctaagaggacttggtatagagtcaccacttcagtcctcaccaaggaacatccaaaaagccctggacagattcacccttaaggagaccagtaaagcatgaactgccctgagttaatgagaaggtcacaaaaagggtctgtctggcctggtgctgagcctgggggcagtgatcagagcagggggaatgcacagctggctctggggacatctggtcatcatgtcacaggagagtgtgtctggatgtggacacctggggacatgaagggctcattaccaagtgatctaggggagatcagagctgcgatcagctaactgcctgcatggtgccctctgctcagtgatcacagtggtgagctcctgatgccccggaacacacagtttcacccttgcctgtatccctgatatccacgagaggggcctgacccaaggccagcgtgtcatcagaaggctggggggctctaatttgcatggatggaccctcattctcagagaatgaagaggggaagggagagatttggggaagctctgtctcagctgtgggcacagaaggaaggcaggactcaggacaatctccagcatggtctggtttcctctcctcctcactctccttgcacactgcacaggtgactagatataaggccatggctaaagccctaggaagcccatgggccctgctttctccttttgtctctcaacccagaatcaccatgactgtttctctcccacttccaggatcctgggctcagtctgtgctgactcagccaccctcagtgtcttgggccacaaggcagaggctcactgtctcctgcactggaagcagctccaacactgggactggctataacgtaaactgttggcagtagctcccaagaactgaccccaaactcctcaggcatggtgataagaattgggcctcctgggtatctgaccaattctctggttccaagtctggcagcttggcctccctgggcaccactgggctctgggctgaggacaagactgattatcactgccagtcccgtgacatctgctgagtgcttgtacagtgctccaggcttgcaggggagtgagacaagaacccccttcctcctttcccaggagggtgagtgcccagcagctactgcacaggcctggcctgtggcttctgcagttgctgtttccccagtgggcctgggagcatccagggccccacctgggagtagatgcttctcctcccctccgtcctcagagtcacccacagcagtccctttctaggaaaagggcctccagaaaacagaatgtcctgtaccctgcaacttgggacacagggtctctgctctaaagtccaggggctggagtgacaaatccagcagtgaaatctcagatctacatctgatggggaacctgcatctccatcatccttttgctatttccaggagttttcaaagcagtgtcttcctctcactggtcctcagtgtgttttcctgttctttttgtttcagcctatttttttttttttttttgagatggagtctcgctctgtcgcccaggctggagcgcagtggcgcgatcttggctcactgcaaactccgcctcccgggttcacgccattctcctgcctcagcctcccgagtagctgggactacaggcgcccgccaccatgcccggctaattttttgtatttttagtagggatggggtttcaccattcacaggattgtctcgatctcctgaccttaagtgatccgcccacctcggcctcccaaagtgctgggattacaggcgtgagccaccatgccgggtctgtttcagcctattttttatgtgtctttttattgaggaataattaacaaaataaacccctgatatttaaagtgcccaattttgtgtgttttaagatatttatacacccttggataatcaccacaatgaatcagtgattccatcagaagaaatcggtgactggttctggcagaatccagggaaccctatctaatatctcgtgaacttctacttggactcaagtaagaaacagggctctgaggctcccagccacatcttgggatctaaagatgcgtcggcctgtgcaaggattttgcacgttgctgtgctgcagcctgagaatgggtctgtctcggggtctgcacaggggcagtggatttcacagtggctctgaggcttacacagggctccaggcccatgggaaagtgagacacaaatcttccctctgctctctaggcctggtgcagtgatcctggctggaggctctgataaatctagctcagaatgtaacttctgttgtgaacatctgattttccttggacaaatagttctgacaatatcttatttcagttcgactagtatatcgatccattgctcatacttctcattccattcttgctttcgcaatcggtggaccctgtcctgtgcccacagttctctgcatctctccctgctagtccagcctcctgcaaaggttcagctcccagaagagactcctacatccactgccctggaagaagcaacactatgagtagaatggcaagattttgtcacatcagcactggggataactcatcactactctgggcccattgaagcaatcacatactctctgaacctcagttttcatttttggcagcatgtaaccctacctcagcagctcttgctttcaacatggggatgagctgaagaagaggcttgtaaatgacaagtatcagtcactgttcaccgtgcaggggtgtctgtgtccttctgtgtcaggctttgtgccagcagggctgtgccccgcaaactcttccaaggtcctccatgcagtctgtgttccctcatctggccacattgtctggaagttaaggtcacctcctcatgcactggaacaagcagcagagtcgagtggacagcgtggcctggcaccgccagctcctacgggagccccagatggtaatgcctgctggtctccagcttgcagggttctgattttgggctcttgctctaggtctggccacttgggcttctgcaatactctgggatcctgtatgaggatgagggtgatgatcagtgttcaggatgtggaaagagccccaggttaacccaggacacctgtctcatggggacatgaggcacaagcctcccatctgatcccacagcctggcctatagactcactttaattttgtgtgactgtcacctgactcaggacattcctgcagtcattttttcctccaggactgatggaatgaggccattccctgggtctgtcgcctcatatgcagtcgacctatatactgggctttcaggataaaacattcccagcctgggcattgcaatacagacaggcaggtagctcagacagaaaatactcttgttgattccagatttctgggcacatggacttggtgtgtgtttgtgtccatgactaaggtcaggtttggggttgggagtgagagtggtcaccacatggtccaggaagaatgtgttgtcaaagataaaattcgtacaccttcctgcccttccctgtacctgaggcagcttcctgaagcctgcaggtttctgagattctccataaatggagaggaaacatcccatagaatggatgggttttttttgtcccagacaaaaagacaagacaggacgagggtacagatgtcagcaagggttaaacagcaagtatgcacttgatcatgccaaagaatactgaaatagctttgagggtaattcagtgtccttgagaattaaaaacaaattggagattgagggcttcaaacccccattaggtccttgtgcaaacagatgctgaattccaacccacattaagaaagaggctaaaaagatgagacaaaatctctgaaagacaggtggaggggatttctgcagtttcttggtgcttaagagacagggacctgccaggcactcacctgagaaatcctgcagggtcacagcacagggaagggaatgtgtcgggtacataagatgactttgatgttgaaaacaccacctctaccactgataatggttttcatcattcatacttaggtgcatgtacaacctctagcaaccataattaccacaaaggacaggcattgtgtaaacttttatgaggttctgtgttataaaataattacacaaaatgtataaataatgtgggcactaataaggtgaggttatatgttgcaatatctggggttcctattgaatttatagactgtaaaactaaataggtgctaatgtaaaatgatacagttagaaatacttgattcatgaaaaataaaaagtgagcgaaaagaaataaagcaaaaagcccaaataaaataaagagaaaggtaaactcacacacaatatcagcaattatattcaatgtaaatgtgttgatgaaccagataaaaataatttccttaaaataaagttacttgtgtgttatattttaaaggatgctaaaaatacactatgcaaacatttacctgcagaaagctcttgtggttatctcggtatcagaccagataatttcaatgaaaattatttacatcaggaaatgtgggacattttatgtatataaaatgaaatatttgacaagaacacataacaattataaaatacacatcagtccatgcatggtggctcacgcctgtaatcccagccctttgggaggccaaggtgggtggattgcttgagctcaggagttctagaccagcctgggcagcatggcaaaatttcatctctaaaaagtacagaaaaaaaaattagccaggcacggtggcatatgtgtctgtagtcccagatacttgggagcctgaggtaggaggatcccttgagcctgagaggtggaggttgcagtgagccaagatagcgccactgcactcctgccagggtgacagagtgagatcccatctcaaacaacaacaaacaaacaaacgaacaaaacaaaccaaaaaagcacacacaaataaacaaaccaaaaaacatgtccctaataatataatctatataaaatataaattagcaggactaaggaagagaaaagaatcaattcccaattatagttataaataatagcacacacttctattaactgagtgaatcagcagaaaaaaaattgcacataacaatatgtgaacaacctgaaaaaccaaattcacccactgacgccaggagcccaaacctgaggagtagttggctaatgaatatgtattactgaaacgattgaataagtgctagaagaaataaatgaggcattcattatttttacccgatttgatgcttctcctctctgtcctgtgagcagggggcactcccatgtctattcctagtcccattcttatcccctcgtctctctccccaagactgagctgcattctgcagggtggctcccgtccccctggagtaaatgactgacgtgaggagccctgccttccagtgctgctgttttcatcgtgctctggtttgaatgtctcccttccaaaaggatttatacttaattgccagtgtgatagtactaagaggtaggccttcaaaaggtgatatagtcttgaacacggagacctcacggttgggatcaggtctcttatataaaggctggaggtagcggtgtgctctgtctctcttcttgccatgtgaggacacagaaaaaaggcacttatcagatgacagtgccttgatcctgaacttcccagcctcaaaaactgtgagaaggccaggtgcggtggctcatgcctgtaatccaagcactttgggaggccaaagcaggtgaatcccttgagtccaggagttcgagaccagcctgagcaacatggtaaaaccccatttctataaaaaatacaaaaattagccagatgcagtgacaggcacttgtagtcctacctaatcaggaggctgaggtgggaggatcacctgagcctgggaggtcgaggctgcagtgagttgtgattgtgccactgtactccagcctggatgacagagcgggagactgtctcaaaaaattaaaaaataaataaataaaaaataaaacagtgggcgagataaagaaaatgtgttacttatataccacggaacactatgcagccataaaagaaagttatgttcttggcagcaacgtggatggagctggaggccattatcataagtgaactaagccccgaacagaaaaccaaatgctgcatgatctcacttataagtgggagctaaactatgaatatacccgaacatacggaaaggaacaacagacactgggaatgactaccagaccaaaaaaaaaaaaaaaaaaaaagaggatccaccctgtggatcctctgcccactgcctgggtcatgaggttgttgggaccccaagcctccgtgtcatgcaatcaacagatgtaactaacctgcatgtgtaccctttaaactagaatagtaagagtaaagagcattgaaagaaaaagtcaagatcagaagcgaagaaaataataaatgaaaaaacacaatctatagttatccaaacaatccatgactgtcacaaacacagaacaaggacccagtggacagaatgaggcagccaaatactcaacccaacatgatacatagggaacacatttttcaaaacaccaaaaagacacaatgggaaagggagagtctggttcaagaagtgattttgagaaaactgaatatgcacatgcaaaacactgaaataagacctttgcattgcacgatacacaaaatcaacacaaaataaattaaagacctaaactcaatcttgaaactgcaaaggtcttataagaaaacataggttgggtgtatattttaggaagcctgtatctatgcacacaggctgcaaaaggtgaaaaataatcataacactaaagggaaaattaggggaactacatgcacagacaatgcaatggcttggctatatatgtgtgtgtgtatgtgtgtgtgttttgtagggtggaggtttggatacaaaaattacagctaacatgcaaatataaacaaagacactagtgacactttagaacttctacagggggaaagaaacaatgaaataaacaaacaaacaaaatgcatcctaaagactaggagagaattatggaaagtcctacctctgaaagagattgttatctaacacctacaataaactcactctactaaatgaaaaacaacaaaaacaacaacaacaaatacccaagctaagaggatctgaatagacatgtgtgtaaagaagacaggaaattgactcacaggttaacagtttctcaatatcactaatcctcacaaaaaagtgaatcaaaaccatactcaggtaccatataattccagttaaaatgaatattgcaaaagataaaaataaaaattgttggaggtgatggctggtgtagaattgcaggaaggaaaactgttgtacgctctttgtgggaatgtaaattagtatacacactatgcaaaactgttggaggttccttaaaaaagtaaaaggtcaaagtacaaccaccactccaggttaacaatcccaccactgggtacacatttagaggaaacaaaatccctgcattgaagaggtatctgccttcccatgtgtcctgaagcactagtcacaatagtcaagatatggaatcaacctaactgtccatccacagatgaagagataaaggaactggatatatacatgatggaaagcatttcagccataacagtttgggaaatcattgatctgcagccatgtggagaaacctggaagacaattaggggaaatgaaatgagcctgttagagagagacccatactgcatgacattaggcaaatggaatccaaaaaacactgtcttctagaagcagaactttcaataggggttactagaagctggagagaggagggggcctgggcagggattggtaatgggtacagagtaacactcagaggagaggaatccattctgatgttctattccacagcagggtgaccagggtcaacaatgtctaggggaatttttcaaaaacagctggaaaggatggttctgaatgttctctccacagggaaataataagaagccagacaccatgatttgatcatgacactacgtatacatatatcaaaatgtcccttgcaccctctggttatatacatacactctatagtaatgaaactgccatcaaatgttggtagtattcattctaactggagtgacatagaatctgagtgtggttttcaatcatgttttggtgtgaatcggccatgttgataatcttatcttttacctgtgcatcaacctcatgtcttcaggtcctctgcccacttttacacatcaaattcaaaacaaattaacaataacatggcaaatataactaatcacacacacacagaaaatgaaaaccaccactcagattccatctcactctagatggaatggatactacaaaaaaaaagttgaaaaatattaaaagacaaaaaaacgatggtgtggatttccagagggggaacttgtctccgcagttcgtaggaacataaactagtacacacactaaagaaaccacttggaggtccctccaaaccttaaaaccacaactaccatttcatccagcaatctactactagtcgtatatacagagtacatgaaatcaagccatggaagagattatctgcgttcccaggtggaatccagcactatgcagaatggccaagatgagaaatcagccgacctgtccatctgcagatgaagggataaggaaactgtcccatgcgtagacactggaatactcttcagccagaaaaatacaatgaattcccatcacgggagccacacggttgcacctggaggacatgatggtaaatgaaatgagccaggcagagacagacaaactttgcatcctctcactcatgcagaagctgagaaactttatctcaaagacctagaaagcataatcatggttaccagaggttggggggaagaaggggaaggggcaaggattggaaaggggtagaaagttccacacagatgagaggaaggaaattctgtttttctattccacagcagggtgactagggttaatagcatcattacatcttcaaaacagcttgaaaggaggatactgaagcttctcgccacaaaagaataaacagtggtacgaaataacagaaaaaataaataccctgatttcgtcattccacaatgtatgcaaagaccaaaatgtcgcactctaccctctcattgcattcctttactattcagcaaatttgtttaaagaaatataaatacatgatgctagaattcacatgggaccatgaatcaccctgaatttcttccaaagcaatcctgagacattcagactacatcagatgcatctcacccaccgatttcaaatttcatggaaaaactgggtacctgcttccacacagagcagtggaacacaagagagggcccagaagtaaactcacacaccaaaaaccatctgatccttgacagaatccacaacaataagcaagggggaaaggatgccctattcaaacaatggtgctgggataagtggttagccatatgcggaagagtaacactgggccccgacctctaaccagacacaaaaagaaactccagatgaatgaaagatttaaatggaagacctcaaactattaaaatcctgcaagaaaacatacaaaatacctttctccacacaggttttggcaaagaatctatttggctatgtccccaaaggaaatgacaacaaaaatggacaagccatgcttaatactctaaagagccaccacacagcaaaataaattagcaacagagtaagagacagcatacagagtgggagaacatgttcccaaactgcatctgatcaaggtctaatatccagaatcttcaaggatcttatgccaatcattcaacaaaaaacaacaaaaaaatcccattagtgtatgggcaagggatgtgaacacacacttctcataggacaatgtgcaagtgaccaacaaagagggaaacatgctcaaactcactcatcaacagagaaatgccaatcaagagcaggtcgagataccatcccacaccactcagagcggcgatgactatgcagacaaagaaagaaagaaagatactggcgaggcagctgaggagaggaaaggctgatatggtcttggtgggggaagcaagctagtacagacactgtggaaagaagtttggagatttctcaaagaacttagaactaccatccaaccccacaatccctctcctgaagatctacccaaggaaaatatatccttctatccaaaagacacaggcacttgtatgctcacggccgtgttattcacaatggtaaagaaacggaatcaacctaggcatccatcaacagtggataagataaagaaaatatggtatgtatacaccacaaaacactacacagcccccaaaaatcacatttttggcagcaacatggatggagctgcaggtcattatcctaagtgaactcaaggccagaacagaaatccaaatgccacacattctcacttataagtgggaactaaactatgaatgcacctgaacgtaaagaagggaatgattacattaggaataactaccagaccaaaaagaaaatgcaaatgggagggagggggcgttgcgtcctgaagacccaccttgtgcgtcctctgctcactgcccgggtcatggagttgttgggagcccaagcctcagtattatgcaaccaacagatataattaacctgtgtgtgtactctttcatctataataaaagtagaaactattacacacacacacacacacacacacacacacacgaagaagcttaagagctacataaacaaaaaaataagtaaaatctatagttatccaaacaatccctcactggcaaacacacagaaacactaacctatggacaaaatgagaaagccaaaaatgcagcccaaaattacatatggtgaatgcatttttcaagagaacaccaaatatcacaacagtgaagagagaagtctgctaattgtctttgagtaaaatgaatttctacctgcaaaacactgaaatggatcctcatgttacataagacaaaaaaatcaatgcaaaatacagtaaagatctccacccaaaactgaaaacacagggtgttttcacaccctagaagaaaacacagggtgagcgtttacttcagtgaaactttaatctatgtacacagattgccaaaaggaaagaaaacaaaagggaaaagtaggaggaagaaacccacagacaatgcgatcttttttcctttttttttgtgacgggacaccaaagtcaccacatgcacatgcaaatagaaacacgcaggactatggaaagctttagagatgttccacaggaatgaaaccaatgaaccgaaagagaaggtgtcctacagatttggagacagatctgaaaaactgtatctctgaaagcggttgttatctaacatgtccaagaaactaacaccactgtgtttggaagcaacaacaacaacaaaaaagacaaaacaaaacaaaaacacaacaacacatatgctgaagcaaaactgggcaaaggcccttaatagacatttctgaaaagatgacatgaattgactaatgagtcaaaaagaagttgctcaactttatcatttctcccgcaaaggtaagtccaaaccacagattctctgggattctggagaatgtgaattctgactcagtaggtctggagtgagcctgagattctgcgtttctaaaaggttcatttccccacaaatccacattatgtgtattaatattaccaagtaaataagaaaggtcaaaaataaaatggcaagccattagtagataaccttagtcttcctcctcatcctcctcctccactgcatgggttaggatggtccccagcatcctgatcccccaggtcactgacatcagctcccaaactcatgccaggaatgtccttccctcttcttccttcaggccataatgggtatctatttttccagcatctttctcccaatctgtgctgatttagccaccctctgtatctgcctccctgggacaaagggtcaaactcaccagcactctgagcaagagctacagcagctgccacatagactatccccagcagagctcagtgatggacaccaggttcacaatgccagtgggcagtggtgctgtttactgcatccagtggggatggagtggttgtccaggcacagacagatggacaatcacacagcaggaacaaatgtacattctgaaatttaacaaagacagaataagggactcttggggaatagaggtctcaattgcagacatagtgagtgcctcaaaaattagagaactggggccatctctgtcatggcccggattcctctctccttcatcctcctcagtcatcaaagagattccattagggggcaatcaaaggatgctggggcctgctactagctcccaaaaaacaccacaagcatttcagcagggagaaaagaaaatgctcacaaggatggggttagatttagttataaaccagattgtgtggcaggagggaggacatatcccccatcctttggccactccaaaattgggagagctaatctggggaaaggcaccaacacctattcattagtgtctcggtcctgtgtgatcatgggtctgtgtgagttctcagcagctgcctctctcaaggtctccccacaggacagcagggtgaaacctggggcaggaagagaggggaagctgatttgcataaagaactttttttatcctattgggtctggggaggcatgaaaaggccctgaggaaaacaaaccccagctgggaagcctgagaacacttagccttcatgagtgtccccaccatggcctggatgatgcttctcctcggactccttgcttatggatcaggtcaggggaagggactctatccctgggggaccacagaaaacagggtccaggttactctcatcctcatgatcataactgtgtctctcctgttcgttttaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttccacagtgatttaaacctatgaggaagtgcaactaaaacctctttatatactgagaacagttcagcccttacagacaggagggaaagtgagagggtggaaatggtcaacacggtgagtgaggagtctcctcgccccagtctctgacgcaggggttcactgccaggtgcctcacccagtctctccccgggtgtgtccaccttcccagtgtggcttttccatggctgtgcttcgtctccactgagaataatgtggagggagaattatctacaaaatatataagctcacagtgagtcacagacaccccagtgctccaggaagacgcttcttattcaaagagaattaacaggcatatgctcactcattaatttgaccatggaggctgactgaatattttatttatcactgaagtgggagcattttcaaggggcttgttaaaaatgtaattctctaacctaaacctactaagtcagaaacttgtgttggtgacagatagcctgtatttaacaagctgtacatgagatttttattagcgttaatgtttgggaagaacctacttttattatcataaaattattcataaggatctccatttataatgatgtcaggttaatattccataatcctactctcctaaattcccattcaaagcccccaaatactcagaaacagattttaaatctcaagccatagcaaaaattataacttgatttatgcagacagagtagggaggaatttctaaaaccgtaagttcctaggtgccaggtgtgctgactcatgcttataatcacaatactttgggaggttgagacaagaggactgcttcaagccaggagattgagaccagtgtcttccacatagcgagagtctatcaccacgaaagaaaaaaaaaagatataagtcccttcaggaatttccaaaaacttgtttccttagggtatatttagtggtccatatgaacatctgttactgaaaaccatcccgtagaggactggcttccagaatcccttctccctcccactgagctcacctacctgtggctctggctctcagggtctttataggacacagggctcagcctcttatcaccgattgttccacaggatcatggttccactgagatcctctcagcatagatacgtacctgtcctgaacagtgtcttttaacataatgttggcaagatgggaaggactaaggggtgacggagccttggagccaccagaagatggcagtaacctcactgctgagctttgctaggccagactcaggctcccaccctcctcccttcctctgactctttcttctggccacccggggtccaggagctttttccactcaatctgggctcaggggtcacctcagagaacctctcaagacaaaggaggtgcttcaggggatctaacacaagtgagggcagattttaagactgtccatgcacagaaaatcctgtgaaaagaaacaaaccagccctacttgtgtctgcgcacctgagtccttaggactgttttctcctgatctcctggctgagtaaagattgcaaatgtgcggttcattatccagatccagagaaatccatgagagtttatgaagacaaagacgacaactaccctatctacttgtcacacaatgaagacactggccttagatctgtcagtgccctggaacattctggaagaagagggtgaaggttacttggcatacgttgggactcaaacatgaggatctcatgatgacccagagggataaaggtgggatcagttgtgagggtggaaaatgtggatttcttaaggccattttgttaatccttttctcattgcaaaggatttaaactgaaatgaacacgatttttctaataaatgcttatgaggctttccattaaatttaatcatatttcctgcctttatgaaaataaatatagaaataaaatatacttccataatgcattactgattgtgtatctttaaactagagggaaccattacttctaaagaaaaattactaggattgtttgcattttaatctgggatcctacatgatggctacagatacagctgttgttcaaggttttagcctggaatctctgccaattcaataacggaggcaataaaaatagacactagtattataaagacagaattcatttattttgaaagttttgaaagctatgaatatctaccaagaataaaataaattgtactgaaaatatattagaatgaattaaaaaatgccaaattcacaactaataaaatttattataaagttaaaaattcttatatttttctgtctcagtataaaaaataaacatttaatgtatctattagaaaataattagcaattttgtaaatgatatcaaagaaaatttgaacaaatggtgaaatattttcttatctgcggacaccaaattaaaaaaattcaggccaggtgcagtggctcacacctgtaatcccaactactttgggaggccaaggcaggaggatctcttgatccaaggagtttaagaccagcctgggcagggacgggtgcagtggctcatgcctgtaatcccagcattttgggaggctgagacggcagatcatgaggtcaagagatcaagaccatcctggccaacatggtgaaaccctgtctctactaaaaatacaaaaattagctgtacatggtgacgcatgcactcctgtagtcccagctacttgggaggctgaggcaggagaatcacttgaaccggggaggcggaggttgcagtgagccagatcgcaccactgcactccagcctggtgacagagcgagaccccatctcaaaaaaaaattagccaggcatggcttcatgtgcctatagtcctagctactagggaggctgaggtcggaggattgcttgagcctgggaggtcgaggctgctgtgaaccgagattgtgctactggactccagcctgggtgacaaagtgagaccctgtctcaaacaaacaaacaaacaaaaaaccaaaaaaaccccaaaataaaacaaaaattcaacagcatgtagattagtaatgttagtgctttatttttaaaaattattgttaacttatatgggttttcctctgagaaggtgcactggaaggtgtcagcagagcagatagcacaaactcctcagatttcagaagcaggggtttatggtaaatgaaaaatgccagtcacttgtcagcatgcacaggtggctatgcccgccctgtgtcaggctctgtgtcagtagtagggtgctccatgcgtccttttcagagtcctacatgccatctatgctcactcagccaggcctgtcacctggaagtaacaggcaactcctcctgcactggaattagcagcagagtcaggtgaataatgtggcctggccacaccacctctcagcaaatgtccccagtggtgatgcccgatagttcccaatcctccttaagtaattaattcacttcaattgaattaaaaaaatcaatcacttccctatgacacacaaggacattcactctctggctttaactatccttgcctgccttgttattatcattccatgtgcccaatactgtcaaaagatgtatttttgccataccctccacatgcatttcatatgtgtgatttttattttcaaattctatatctcttctaggaatatggtgtgttttatttgtcctgctgcaggactcccctctccactcagattaaattattaaattccagataaaaaattaacttggaatactgttgaatcaatagtagaagtaaccaaaataataaagatatttcaaaatgaagattgatttttaaaagtaaaaatgtcacatactccacctagaagataagagactgtactacaaattcattagaacatccccttcatgtcatgggccagtcatgtccctgaacttaacctctgtcttctcgggtgatgttacaggccaatgcagcatcagctgcccacactcctagtggtggaatctgggagcacaggcaggagtctgcgcctgtggccttggctgggtgaaagatgacatttccaagacttcttgcttggcagccatcctcacgtgcaggtggtctggcagcagcactgcaaaacccaggcaagggatgccccactgcaaggcccagtggtaactgtggtggccattggcattgggggcagatgcagccatgtgagttggtgggctgtggcagccaccctaatgatggtttccacccctcccagctggtggtggctaaaaccacccggtaggagtttcaaaagcagtggcaccattaagcggagctcctggaggaggactggaagcaactgcttgcattgaaggaatgtagctatagtggaattattgaaccacatcatatttgcaaagatgcagaatgtattacagattacgagatatggaagttgaggttaatctggtagagagcagtgaatatgaggaggaagctctctattgggcgggtgctatcatagctgcagaaggtgatggtgcaatgcttctgccagtgagtaaagtcttgtacaaacttaaaccagttacggggtaaaatctgatccaggactacctgagggtcacttatgttggcctgttcaatacacacatttctttccaggagccttaccaaaggtctatagtagtgagttcagtatggaggcagtaatcagatcatatctggaaggaactggcataaactccaatcctgtgggacatcatggacagcaactaaattcgaatcaacagagtagagcccttgacattggacaagttcgtggtgaaagatctgaggctttaggactccgacatttgtgaatgacagcactaaatgaagtctttactggtgaacgtctatccagaataccttatgcttgggctgtggcagtggataatttaagtagacccactctatttatttatttattttgagacggagtcttgctctgttgcccaggctggagtgcagtggcgtgatctaggttcactgcaagctccgcctcccaggttcacgccattctcctgcctcagcctcccaagtaggtgggactataggcacccatcaccacacctggctaattttttgtatttttagtagagacagggtttcaccgtgttagccaggatggtctcgatctcctgacctggtgatccatccgccttggtctcccaaagtgctgggattacaggtgtgagcctctgcgcctggctaagtagacccactctaaaagactggtttcttactgtgagatttcagttggtaatggtccatgggaaaaatggaagacttcagggctcaatttgtgaactggagcaagatcaaaggcaacagggttgcaagtcaggctgtggagcatgattaaaatattgcaaatgacaaggacgttggagtcttgcattcaactgtaaaatgacagaataacaaataaatataatgaatcattgttctagagtccaaaaagggccaaaagtaattttcagtattcaagaactaaaaagcaagcagttttctcgagcacccatgagcattgtttctcctgagagatttgtcctcgttttcattgctggaacacctgcatggttgtagatggaggaatgtcttttgatgttcctatttttatatcagacaagctttaaagcaacaacagttataaaagacaaagaaggaaattttataatgataaaaggatcggtccaacagaacaatatcacaatcctaaatatatatgcacctaatactggagctcccaaatttataaaacaattattactagacctaagaaatgggatagatggcaccacaataatagtaggggacttcaatactccatggacagcactagacaggacatcaaggcagaaagtcaataaagaaaaaattgactttaattatatcctagaacaaatagatttagcagatatttacctaacattctacccaacaacttcagaatataccatattttaatcagcacatagaacgttctccaagataaatcataagataggccacaaaacaagtctcaacaaatttaagaaaattgaaattatgtcaagtaccttttcagaccacaatggaataaaactggaaattaactccaaaaagaacccttaaaactatacaaatacatgaaaattaaataatctgctcctgaatgacctttgggttaacaatgaaatcaagaaggaaatttaaaaattgcttgaactgaacaataatagtgacacaacctattaaaacctctgagatacagcaaaactaagaggacagttcatagcattaaatagtctgaaacagcatgaacagacaatctaaggtgacacctcaaggaactcaagaaacaagaaccaaccaaactcaaacccagaagaaaagaaataacaaagatcagagcagaactaaataaaattgaaacaaaaaatacaaaagataaatgaaacaaaaactggttatttgaagagataaacaaaattgacagaccgttagtgagattaaccaagaaaaaaagggagacgatccaaataagctcaattagaaatgaaatgggaaatattacaaccaataccacagaaatatgaaagatattcaaggctactatgaacacccttatgcacacagactagaaaatctagaagagatggataaattcctggaaaataagttattatttgaaaaagacacttgtatggccgggcacggtggctcatgcctgtaatcccagcactttgggaggataagcgggcggatcatctgaggttaggagttcaagaccagcctggccaacatgttgaaactccatctctactaaaaatacaaaattagctggacatggtggtgcatgcctgtaatccccgctactctggaggctgaggcaggagaatcgcttgaacccaggaggtggaggttgcagtgagccaagattgcaccattgcactccagcctgggcaacaagagcgaaattctgtctcaaaaaaaaaaaaaaaaaaaaaaagaagaaaagaaaaagacacttgcacacatgtttatagcagtacaatttgcaattgcaaaaatatgcaaacagtataaatatacatcaaccaatgagtgaataaagaaaacgttatttttttatttttagacggaatttcgcttttgttgcccaggctggagtgcaatggtatgatctaggtttaccgcaacctctgcctcctgggttcaagtgattctcttgcctcagcctcccgagtagctgggattacaggcatgtaccaccacgtccagctaattttgtatttttagtagagacagggtttctccatgttggtcaggctggtctcgaactcctgacctcagatgatctgcctaccttggcctcccaaagtgctgggattatgggcatcagccactgcacccagccaaaaatgtgattttatatatatatatataatatacaccatgaaatactactcagacctaaaaaggaataaaataatggaatttgcagcaacctggatggagttggcctcgtttactactctgggtttctgtctgaggatgagggtgatgattgctgatcaggatgcggaaggaacccagtgctaacccacagcatctgccccacagggaaataaggcacaagtctcttgtttgatcccacgctatgacctctagacctactcttccctcttgtcaccaaaaccacaatcaggaaaaatttctgcaggcatttcaccatcctggaacaaggatctgagactcttcactgaatttgtgaccttctatccagccaatatttatactgagctattaagattaacatcttagcctggtcattgccacacaggcaggcaaggcagctcaggtggaaaatacttttggtcatcccatgtgtctgggcatatggccttgatgtgagtttatgttcatgctcaggacaagttatgggtcaggggactagtcagcttatgggccaggaaaaggtgctaaggtttgtggagtcaaagagggaattcacacatattaatgctccttgtttccacctaaggcagtttgtgaagtctgtgggttctgtgactgtccacaaatggagcaggaacattccttagaacggatgattgggaccccacaaaggaaaagacaagaggaagcacaggctacacaatgaaaatacacttggtcatgccaaaggctaggtcatgccaaaggctaatgaaagagctttgagtataattcagtgcctttggggttgagtggaaaatacaaaaaccatctttgccctgctctcacaccacaacaatcaacacgtttccatgaccaaatgtgtaggatttctccccaccccctagaaagcaagccattggttttgcagcggacaccacacaggtgccctctcattgaatgcaattctgacactatccacatggagacagggtcagatcttacagtttgagggctacttccccaagactgtgccccactacttacgccaatcccaagcctcagattgctttacctgtgcttctgtccaaatagctgtaagttgaagatttcacaacatctccttggcttctattaatttgctagaatggctcacagagctcagtagacacttacaggtttattaaaaaggatacaaccaagcatatagatgaagacatgcatagcacaaggtatgggaagtggtgcaccaccgtccagtaatcttcatgtgttcagccttccagaagttctcccagcctagctccatttgggttattttatggacgcttcctcaccgaggctttatggagtaaaccactgcccattggtgaataatcggcagcccctctcccctccacagaggttgggagatgaggctgaaagtcccatccctctaacactgccttggtctttcttgtgacctgcccccatcctgaagttacctagggactgtcagccaacagtcatctcattagcatacaaaaagactctggtgattttaagtattttaggagttgtataacaagaaatggggtcaaagaccaaaaccataatttataataacacagggatgaaaaagaaagtagaggttgatgatttcaagcccacactagtcctcattatgacagatgtggatttccaacccataagaggcaggaggctgaagagctgagacgaaacctgtgaaaagcagggacaggggacatttctcaatttcttgttactgaagtgatagagctccaccaggcctcacttggattgacaaactaaattaaaagatacactctttaaataaaaagcacttctgagcatacatccaaaagaatgaaaatcaggatattgcagaaatatttgcacatttttattcatgcagcattaatcacaatttcaaagacatggagacagcataaggtccactaatcattgaatgtttacagaaaatgtggtgtatagctgcaatggatgctgttcaaattcaagaagaattaggccgggcacggtggctcccgcctgtaatcccggcactttgggaggccaaggcgggcggatcacaaggtcaggagttcaagaccagcctgaccaatatggtgaaaccccgcccctactaaaaataccaaaattaactgggtgtggtggcagaagcctgtaattctagatactcaggaggctgaggcaggagaatctcttgaatccgggaggcagaggttgcagtgagctgagattgcgccactgcactccagcctgggtgacagagtgagactctgtctctcaaaaaaaaaagaataattaaattttgccatatgcagcaacagggaaaaccctggaggatattacactgagtgaaataagccaatcttagaaggggaaatgctgcacggcctcatttatatgaggtatctaatttttttttttcgagacagagttttgctcttgtcacccaggttggagtgcaatggcgcgatctcagctcattgcaacctccgcctcccgggttcaagcgattctcctgcctcagcctcctgagtagctggtattacaagtgcctgccaccacacctggctaatttttgtatttttagtagagacacagtttcaccatgttggccaagctggtctcgaactcctgacctcaggtgatccgcctgcctcgacctcccaaagtgctgggattacaggcatgagccaccacgtccggcctataggaggtgtctaatatactcaaccgagcagaaatggagtagaatgctggttgccaggggtagggagagaaggaaatggggagtcactgctcaagggctatgaagctttaggtttgcaaaatgaacaagttctagagatgtgctgtacaacactgtgcttacagctgacaacactgtattatgtacttaaaattttattcagagggtatatcacacattaaacgttcttattaacatgaaaaagggatagaaaataccatgaaaccacttacagaaagcaagtatggcaatcctctgtcctttgtcttgggagaaagttttggccaagagacaatttaggcaaaaaagagaatttactgaagaaaaacagagagcaaatagtttatttagagagacagtgtactctggaagataaggcagagcgggctgctgatagagaatgagccagcggcccgagaaatgtgcactgagtttttatgatattgcactttttcttggagttcccacctctgttttaagtctccacctttttttctttctctagtttttctgcttcagccttaagtccctgccttttccccacatagtttccagcccaggctgtgggaccctcccttaacacacacatgggcccagtgtttgataggaattctacctaatggctgcattgctcattactgccaccccaggaaggttgtatggtggtcaaatctatacttactgtacctgcatctctcttagaaatttctcctttgctctcacccctattatcagcatgcagctagctacattctgacaggttaacttcagagtgagtgaatactgggtgtcttaaggggctttgttctggcataggtatttaccctaatctctgttcgtatctagcatgtgtgctttgggtggtctctggggtgtgagattttccagaactcccttttctcaggggctgcccctcctgcttctgtctagctatctgcctactctaaagttagtattagtatgaaagcttttatgaaaaacatttttttccaagaaaagggaggcattttatactggtgaaataaggtgttcaatgacaacacataacaactgtaaattgtatgcacctaataaaatagctttaaagtatttgaagcaaaactgtctcttttagcagaattaaaaagagaaataatcaatccataatcatatacacagatattaatacaactctcttattaactgagtgaatgacatggagaaaaaagagtatacatacaaatacgtgaaaaccatgattaacaaaatcaatccagtgacaccaggaacccaagcctgaagggtagttgcttgagtatgcattcatggatgaacgcatccaatgaatcatcacaggaacaaacaattgaggccttcgtttatgtatttctaactgatgttaagtttttccttcctattctgtgagtagaggtggatccctgtggaaggagctgcccgggtctttgctccagaagctgtctgcattctcccctcactgtagcctcgtcacattaggccattgttatatttcccatatgtccttcttctagtaatccaggagccctcaatgaaaaggctgtttattaataccagtagctcaggacagagcaggggcatggctcatggatggtttggaccaggcccttagatgactgcactcacatgattcccactgagactgcagtctggccagtgagcagcaggggcactgtgggtctgtctcacggtctgcacagtggctattcatagctgtgccaacccctaaattccccagggctgggcagtggagcctgcactcactgaagccgactcagctgctgcatcttctctgggtgtggttccagcacccacttcctcccaggtcctgccagactctctcatccaccagtccccaggtcttgaataaatgcatagagtggggtgggggcaggcagtgggtgggacacatttgcatccataacccttcctctgtgaggccagtggaggggataagagaggcctagggcagccactccagctctggacctcgggagggctgtgtccaccatggccggggcccctgctcctccctgctgctcccctctcacttatcaggtagggacaggcctcagattcctgggaaagcctcccagtctgagttcttgccccgtgttccactctcacatttcatccctgcttactcacccatgagcatttgtgtttgcaggttccccccacctcggcctgttctgactcagccaccctccctctctgcatctctgggaaattctgaggctcacatttaccctgagctgtggcttcactgctggtggctagcacatatcctgctaccagtagcatctagggagtgctctctagtatctcctgagagatgatatatctccagtgggatagatatctcaagagtgggctcctgataaaaggataaagttcaaccctatttactcattttcacactcttctttgccctttttctctgagataatgcagcagaaagacccttgccagatttcagcatctgcttgtggacttctaaggtcacagaaatctcaaccaaataaacttttagtctcagtaagttacccaatatatggtattctattgtatcagaagaaaatggagaaaatggactaggacagcacgtgtagaacagtctgctaatctgactcaagtaagcaccatggctccagggtccccggtcacttttctaaatctaaagatgcctcagccaatgcagtaattctgcacatctctgggctgcagccagaggatgaggctactacatatctcagcagccatggcacttccacagtgctccagacccccagggaagtgagactaggacctcccctgtgttctctctgcctggtgcaatcaccactgtcctgcctgggaccaactctggctcagggattgattcctgttgttactttttcagccagtgtctaattttcctaggatatatagatgtaaaatgtgtttttttcttaaaatgttaatttgatatatttttcatatcttttccccttatgatgcctacagtggagtaggtcagttcttagagctaagtttccctccaggaagattacagaagaggaaggagatgaataacctacacgtgctgtcctagtccatttcccccattttcttctgatataatagaatatcatatgttgggtaacttactgagactaaaagtttatttggttgagatttccgtggccttagaagtccacaagcagatgctgaaatttggcaagggtctttctgctgcattatctcagggaaaaagggcaaagaagagtgtgaaaatgagtaaatagggttgaactttatccttttatcaggagcccactcttgagatatctatcccattgccaggataagggcactaatccattcatgatggtggaaccctcatgacctaatcacctcttaaaggtcctgcctccaattacttttaccatgataattaaattctaccatgagttttggaggggatattcaaaccatacacatgtcccaaactagggcctagacctgacttagagatgtgtgtggtctgagaacttctgatcagctggttggtccagcatgccccaaccccagctccactgaccagctccaggagtgagtgaggtcaccttcctcacaactgctcattccagcctgtctctgaactgttcactcctcttgaggttcagaggatgcaggtctttgtggttccagggatgttgggcaaacagtcttttccacagtggaatatgactgtgcttgtgacttcgcagtgtgcagaggacactcagcacctgcctctcccccccgactttgtcaggcccatgattatcaccctctccttcatcccaagttcatctgatacgcatgccaagatttcagtgaggctggggacacataaggatgatgatactaaaatgaacaagttccatttcataatagtggcagaagatcagagatctgtaggggagttgtgcccccactctgagtatttaggaagcaactctagggacatcttgctctgcttctcccttctctgcacaggtgaaagaaggagcctgtgcagacaatcgttcattagaagctcctgccttcttcctcttttccaccccctaggactggatggggcctttgtaatggcttcaaattatagtgagagtcaaacaagacaattggtcaatgactccaacatccctctcagggctgcctgacatgagacaggatggattgcatctgatacacccccacccttctttcttatcggtatattaggtttttcttattgatgtgaacacactctatattacacaaaataagttatatttatatttcaaacctgtgatggtgatttttaaattatagtaaaaatatacatataaaatttaccatcttaatcattttaggtgtacagatcataagtattaactatattcacattgctgtgcaacagatctgcagaaattatccatcttgcaaaactgtagctattgaataacagctccccattttcctgcctcttgtggtggttttaaatacaatgcaatacatactagctgaaaatggaaaaaagaagtatatgaaaatgttaaatgcatagcacaaaaaatgaataatagggtcactttggttataactttaaatgagaaaactcaaagtaaaacaacaatctatgatatatcatataaaatgcacaatttaaaatttttaaaatttaatattaacaaaaatatatgtaatacaccacataagtattcaataaaactgaatacaattatgtttaatttttttaaactgtgaaaaagatcctattaacttttgaatatttacgcaaggaaaccaagtacatctcttcttgaaaaagtttgattccaattttttttttctttttttttttttgagacagagtcttgctctatcacccaggctggagtacagtggcgtgatatcagctcactgcaagctccgcctcccgggttcacgccattctcctgcctcagcctcccgagtagctgggactataggcgcccgccactgtgcccagctaattttcttttgtatttttagtagagacggggtttcaccgtggtcttgatctcttgacctcgtgatctgcccgcctcggcctcccaaagtgccaggattacaggcgtgagccaccacgcccagccagtttgattccaattttaacagacaggtgtttttgacaaccagtttattttcttactgaaattttctttttctttttttaaaaaattttaaatctttaatttccgttttcacttattttcttcttgcttccaaaaggaaaggagtgcgtagctctgttgcctgtacatcgtccacagcccctggctcggggcagggtcccctaggccgcccgggggtccacatgcagcccctggggggccggcgcggggtgaggtccggccggttggggccgccgctaggcgcgctggctgggcagctcctgggagatgaagcgacgcaggcgctccaggtactggctgtagagctcgatgtcgttgtgtccggcgccctccacccacagcggctccaccgccttggggcagcgctcgtagagcgccagcccgtgtgagaagtcgatcacctcgtcctctatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgaggcgcgcgcacccttcccaccagcgggcgtccccgggcccagctccggatgcgaccctctagtctccccactcagccaagtcagtgggtcaggcccaggctccacaccagtcccgagggccacccccagcccccaacaccgcggcggtgggcgaggccagcggccccgccccgttccctggcgctgccgttcactggcgtttcctagcaaggatctgcagggatcccgcctacggagtgcccctggggcaggggtaggggaggccctggcgcctgttctcctcctggtcacccctaggtgcacactgggaactgtgtgccccccacatcctgaatgcttcaggcctccctgcccgggttagaaagccgttcctggtgcactggccaggacagcggacactcttccttcctgcagcccttgcccacccccttggccatgaggaattcaggcagctgtgtccccagatgtctccacccaattttggactctcggagtccccacgcccaatgagatgccagtgcaacccaggtcagcatcgaaggtggtggctgcggaggtggcaccccctcccaccagcaccttcccttgggagtggacaagtcctcggccacctcagcaccaccagctcccacccagggccacccccacccccaggtcattggtgtgcggcccttgacccagctgatccagcaccagttacaaggcctcctcgtacccagtcccaaccacgcgggacccacctgccaccctgcccatgccaggaccccacaactctcctcccacacgctccaggctctgatcccaggcagacaccctcttgcaaggcaggagcatgggcaggtgtgcgtcccctctgcctggcattcggactccaccagcagggctgtccccgtccctggcctggaatcccagcctcctggcagcactccacagctcgccactcacccatgccccaaaggatgctgcctggctggtacctgtggccccagctctgcctcggcctccctggcctgctccctggcagccatggtcagtagtgtgctgagccagcccagccctgtcacctgctacaggcaggagcccccagctgccacctggatgtccccactcaaatgaacgggacacatccccagtggaggccctgggcacgctctggcctccccctcacagctctgggcctaggttcctgcaggacaaagtggcagcaggacagatggccgagcagacgagctcagagctggccatggcgggtgtgactctgccagtggcccaggcagtagagacaggaggggccgaggaagtcgcatgaagtggtacttggtgtcagcgccccacactgctgggaggcccccagagccagggtggtgccaggggaccagctcccaggcccacagcagggaccgcctgcaatatcaccaaggcaacgaggaccccacctccccagggcctctgacttctcagagttgtgcctggtcccctgtgggagcaggtcagaccagtgggctgggcagggccaggatgagacagccccagtggatggcgagcaggaaaggccgccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgccttggcagatgggctcccagccacacgtgcacagacccccagaccaccacccactccctcccaccgggtggcatccacgcccctgtgacaagctcagccccttcccgtcctcaggccaggggttccagggagcctggctccacaggccagggtgtgggaggaccgcctggccacacctcagccatgtggaggtggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgtgcagggcctgccaggcggcgtcgatgtcggcatagaggttcctctcggaaggcctgcccgcgctggcaccgtagccggagtagtcgtagaagatgttgcaatggaggcgggagcccaggccaatgtagaagctgctcatctggctcaggtccacggcgttgccgtgcgagaagaagaccgtgtacctggcaccaggcacgcagcgaacatacatgcaggagacgcggttgccgcgggcgctcttggtggggaagacctcgatggtgtccagctcgcgctggctgtactggaagtcggcgcgctccgtcaggtgcagcttccagcgcccaggtgcgcccgaggaggcccgcagggtccccgagggggcggccccggccccaccaggccccggctcaggctcaggcaccaggaaggcgagcttggcagcgatgcggccggggcagggcgggcagcaaaggcagcagagctcactcagcgacagcccattcatggcgggcgccgcccgggccgggcctccaccggggcccccgccaacaacgccgcctggcctggcccggcaggggaagcgtgggggtgctccgagtcgcgggcaggggggagagcgcccccccagctaccgccccagacggcagccccgttaggaggccagggcccagccccatcgcggtccaagccgagccccagggagcctcgcaaccacaggtctccatgtcgtgccctgggaagcccatcccggcccgcgcccccgggccccagggccgcgctccatggctcccggccgcccgcccgtgcatccgtcggtccctctgcgccccggcccggcctcctgcaccgccaccgccgcagctcccccacggacggaagtgagtttactgaaattttcaagccacagaaagaacaaaagaagtaatatccattatattgtccaaaacaatagtacctggaagatctggaggcaaaaatgaagcctgagaatagcaggacatagacatatttcataacatagactcacagcagaataatggttatgttggttcattagggaagaaaacactaaacagctcttgcagatacactcaatatacagtaagatagcttgtgattttaacgagttagcaaagcagaacaatgaggcaaaagcaaacagaaacactaaaagaaatccattccctagaatcatttttaaagactttgctagatttaccaaagaattcagtattgacttattctgtctccattttatttcataatggaacccgtctaattttatgctaaatgtatgctgtaaggacaccttgctactctgaaaaaataagggatcagtggataaaagaccatattttattaaaaaaagagtgtgttttgatgcatgattttgtgactctacatttttaagtaaggatgaagaacttggtgattaattaaatgattcctcagttgctcatcaatgccatcagatgccttgaatatactgtgaggacagcatctggaagaaatggaggagatctgagtaataattcagatggagccaatttccacaatcttattttcccattacctgcagctctgaatttaactaagtctctgtgttaacaacttgtattgtttatctgggtgaatgacctcagaagacaccaggcagctggatgcctgcacttctttcgtgctaatggttcatatagtctcctcacccccaacactttgatacttccttgaaactggattacatatgagatagaaacaaagaatgcaggtggcataatgactctcaggagtcactgaatctgtgttcatgatgcattactgtgccagctgcctccctcttcttgtgaaggcccttctttattccttgagatgtgctcatcatgaaatagctacaagcatatcatctgcttgccttgcccgttatagcaaccatgaaaataaatttgcagcatcatatatagcccaaatattctcgaaagatgatcctaatagctctaataacaaaataagttttctacagagtagctatatgtacatgctctcagcttatgtaaacttgtgtttttattgctcttaaagcaaaatttttcctaaaattgagaaaagaactaaagttctttgtcattatatgaagaaagatacagcatctaatattgtgaacttctctattttgagatgttttcagacatcaagactggataataggctgggcacggtggctcacgcctgtaatcccagcactttgggaggccgaggcaggcggatcacgacgtcaggagattgagaccatcctggttaacatggtgaaaccccgtctctactaaaaatacaaaaaaattagccgggtgtagtggtgggtgcctgtagtcccagctacttgggaggctgaggcaggagaatggcgtcaactcgggaggtggaggttgcagtgagccgagatcacgccactgctctccagcctgggcgacagagcaagactccgtctcaaaaaaaaaaaaaaagactggataataaaattatttaacaattcggaacataaatttagaattgaaaaaagctttatactatactatactatactatactatactatactatactatactactaacacattttgtttgagcatggttgccttataagtttttggtagttcaatgaaaataatggctacttgtgagaaaactgaaatagactaggacatagtagatagagatagaaagaacaggtaaattaactgtctatgccacatggcaaagaaagtttacagtacgtagtcattaaacgtacatgcttataaatatataaccaatgatgaataattttaaatgcaatttagcagaattcagaccgttttatattaaacatatatttctgaatgaaatataaaatctattgaatgagggagacactttatatgtgtaattaatctcataaatagagaagacttttacaatagtttgtacactttagctataaactgtaattcaagagattcagtaagagtagctttttgtaacttaaatattctatattttccctgcatacatttttgcctttgatcatgtattttatttagcctgctaagatggtagagaaggtacagacagtaagcttttcaacctgacacataaattcaggttatttgaaaatggaatggtaaagtgttactgaagaacttttactatggttcgcatttggtaatatttcctaattattctataaacaaaatccaaaaaaaccttgatttcataacataaacttctgaggtctaaattaatcaataaaataaatttgttttaattaattattagattaaattatttatttaaataattatttaaataattatttaaataattaaattaattattagattaaatactagctgaggctcattagaggtaaactagagaattatcatcccattaagataaattttgattcagggaagtaacatcttggaagtttactaaatttaaatttaggaggaatttactaaatcaagtaccaagattttatttctgcaccaaatggaagacatatgtaaaatttaaatacattccattacttaatttactctttactatcatgagaattagtatagacagcatattttacacagagcatacaaagccttatcttcattgaattacaagtaaaatatatgtatgtacatataattatatatgtaatttagatattaaatgacagaatttacttatttacctgtgtgtgatggaatttgattctagtaattattccaggtacagtaactggttgaaaatgggacatgaagtaaactgatatgcttacaagtaattacagcaagcgaattcattgtaatgtctccaagcaaagcaagactacccacatgagataagaaatgagaggctacttattttgaccaagttagctcggtgacttggggaccaaggactacatgcacatggatgcttcttttgtacccctacccctgccaaaaaatatgtttccatggcaatatttgggaacccattatttcccaattgatgcttttactttcatataagacaacagttgatactccaaaatcaacttacattttaattaaccaaatacaatgttcctaaagacaaagagaaacatttcataacaataagagttaagccaacagaaagatagggagtatgaaaaaacagagaaaatcaataaaccaaaattaaatgcttgaaaagacaacacaattggcaaatgtttatttaggctaagcaagaaaaaagcagaagagactcaagtttctaaaatcagcaataaaagagaatccatcactgctagtaatacaaaataaaaataaaagacaatgcaatgaaaatcttatgctaaaaaaattagatagcctagatagaatgaagtcctagaaagacacaaactaaaacagactaaaggactaaggagcaatagaaaatctaaatagacctacaaaaggtaaaaagattggattgtaattttaagaacttataataaaattcccatctcaggtagctatcactctgagaaattaatatcaattgttcaccaactcttgcagaaaataaaaggggagagaacacttcccaattcatcttataaagccaggattactctgacaccaaagctatatcacaaaacaatatataacagtatctttcttttttttttttttcagatggagtctcactctgtcgccaaagctggaatgcagtggcccaatctcggctcactgcaacctgtttcctgggttcaagtgattctcctgcctcagcctcccaagtagctgggattacaggtgtctgccaccacgtccggctaatttttgtatttttagtagagatggggtttcatgttggccagactggtcttgaactcctgacctcaggtgatctgccaatctctgccttccaaagtgcgatataagtgtcagccttatatcacggtgagccactgtgcctggcccattgtttaaataaaattaaaaatcttcaacaaaatactggacaaactgaatccagcaacatataaaatagattatacactatatgcagatgtgatttaccccagcaatgcaacattgatttaatatttgaaaatcaatgcatacaaaaatcgcattaatagaataaaacacaaaaatacatgagcatctcaacagaaagtatttgagaaaatattacacattttcatcataaaacactccagagttatggacaagaagataacttcctgaaactagtggtagttatctatgaaacccacagctatcattatacttaccaaggagagagtgaatgactaatcagaatgaccactcttgcaaattctccctttttcaccttcctgctctcatcaccctcttttgctcctccatcttcccaaaaacattttcccccatcttttcccaaagccttctcccctctcctgctgctcaccaccattttatccccctccacctaccccaaaacttttttctcacacccccaccatcttttcacaatgccttctctccactcctgcttaccaacctcttttccccactcctgcccctctcccatatgccactcttttttcaccctccatctaccccaaaactatttgtcttcccaaccctcctccccctcatgctcgccaccatcttttcctcctccatctacccaaaaacttttctccccactgtctttttgcaaatccttccctccctcccgcttgcccattttccccacctttaccaacctctctttactcctcccacttgccaccctcttttccccctccatctgcccaaaaactttttacccaccatcttttccccaccctgttttcacaaaaccttttctccctcctgctcagccccccgtttttccctctcctatttgccaacctcatttccccctccatctacccaaaaacgtttttttttcccaccgtctttttcctattgcctttttgcaatgccttctcctgcttgccatcctcttttcccgttggtactcaccaccctgttttcctcctccatcgaccccaaaactattttccccctcttaccactccggtcgcactgcagtcgccatctcggccaccacccacagtgaggcgagccgcggtgccgcaggctgcagcctccagcatttggcaggtgtcttccttccccttctcctctgcctttaagttgggcacagaagagctgtgtaggcaaacaggaaagaacccgggatggtctgactcccccacctcagcatactttatatgcggagttatgcaaatgagttctgggactacatgttctgattggatgagagaaaaacctctaggcatacttagattggactttgttatcatgttctgactggatgagagcaagtcttaaaacgaccaatcagaacatgataataaagtccaatcagagtaggcctagaggtttttctctcatccaatcagaacatgcagttcaggaattcatttgcataccctccctgtataaagcatgttgagtgggcagagtcagggtcttccgtatattctccccgcaccatccgtgctcggcttagtgcaggaagaggagaagaacgggaagacaaccgcggcacagcagcttacgtgctgatgttggctgtggtgatggagcctgctaccggagccacagtggcccacagcgggagcatggccagagtggtggaaagacagtggggcaggtatgctatcagagctgcgctgcccgcggtgagggcagattgggggcgctatctggggttgcattgcctaggtgggttctgtgcagtatcggggactacgttacttgcggaggtggaacaggggaagggggtggggtgggggggacactattgaggatgggattaggtgtgctatcgggggccgtgctgatcatcaaggcagcttaggtgtgctatcggggcaggggacacgctgctccgagttgggggatgttacaggggctacactgcctgtggctggcaggggttaggggcactatctggggctgcacagccggtagtgggtggcgtgttagggacgctataagctactgtgttgtctgtgccccagggagggttaggtgtggggttgggtgtgctatcggaggctacagtgctagcagacaggttaggggcactgttgggtgttgcaccgcttgtgccaaggggtatgtttggtgtgctatttggggctacaaggggcaggttgggagcactgtcgggtgctgcactgcccatggcaaggggtgggttgggtgcactatcaggggctacactgcccagggcggggcgggcggggggggcgtgctatcctgggcttcactgcccatggcggggggctggttggggacgctgtcataggttgcattggggtggtagggggcgggttcggtgtggtattgggggctgcattgccagcagtgtgggggggggggtggttgggggcactgtcaggagcttgcgctgtcaagctagtagcaggttaggtgtgctattgggggctgcactgcccgaggtaggggggcggattaggtgcgctattgggggctaaactgcccacagctggcggggtttgggggctctgttggggggttgcagtgtcagaggcgggttaggggcattatcagctgctgcactacccgtggcaggaatcaggttgggggcactatcgggtgctgcaatgcctgtggtggggacgggttgtgggcattatcgggtgctacactgctggcggtggagtggttgggggtgctatcggggtcacactgtcagcggcgggggacaggttaggggtgctatcggatgctacactgtggtggagggcagggggtggggtgttgagagcgctatttgaggactacattgctggcagcggggggcggattaggggcactctcagggctgcactgccggcagcaggcagcagaggtggcagtgacagcagtggtctccacggaaaggacagtccttccctccctggactccaggctttacaaagcgattttctcctgcttaagtacagaggacatacagtgtttccgcaggaatactgagcacggcagggccccccacatctgctgtggtttcctgggttacaccctctcgctctgtgttgtggatactgcctgggacccccaggcaccgagtaacgtgcaccacgtgggggacggtgctctctgggtggaggctcaggaatgagagcccgcacttgggtggggagagctggctgggtctgactttttgctgcttccgttcccctaggaccgcagctctggtgggcccagtggttcctgcggagtggggagccgggcactgtggtgtctccagtccccaccacaggctccgattcatggccagcttgggccgaaaggggagggtgggtgtcagtgccttcgctgaaactggcacctgccacccagtggccagcatgaccaaggtgaggctttaatgctaccactccctgcatctgttctaggtttttctggctttgcctgcccagcagtctgtgcccacctagaggagtaggaggggccaccatgccgcatgctggaggctggagcccgcagcctgcagatggcacagtactacagctcgccttgctgcggttggtggcagtgatggagactgcagctcgaccccagcgatggaggctggaggtaggagggtacctggtggtggccacgtggtaggagccttgtagggtggggctggtgcattgagagcaacagcagcagtggttgtattggcatgggcattagtggtggcagcagcagcaagtctgtgagccgggaagggggtagtaggagccctgcaaggcccagctggcctggggtgggtaagaagcagtgggtgctgcagcatgggcctcggtggcagcagtggaagtgcagccagggcaaggagtcctcccccacctttctgcagtctctggagggcgcccacctcctgctggctcctgagccaggcatgagtggcagcattgtctcattcttaacaaaatttagggaatgactatttgtgtatctttttgcttgttttttgttgtgttaatcttggacttttcgaatttcatgaatcagggagtggataaaaggtatcataataggccttctaactctatcacctgatttttttcctttcttccagtctgttttttcttatcaccatcatcttgttctttattttcttatgctgctgcctatatttctggtttctattcttgtttctctttctggtcctcctgctttttgttttctttatcccaagcaatggccttaacaaactgaaactgagttaaaagtaaactacttgctagtgtgttgtatttttaaaataattggtccattactgtgttttagagatgagaaagtagttgcataatgatttagttacttgaatagctttgctttcgtgatcctgttaatgcgttgtaagtagttatgcaaggaatgaaaaaatgaagcatcaaataaaatactgatagcaaacagtcatttcatctctctcccatatagtctggagataaatgcaagtcagggggttaataagttccaaaaatttatgagatcattaagtgaaccacattcccttcattttatttttctgccacagttttcaagagcgttgtcatttgcatgagcaaaccttgttcaccacatctttgcaacagggaagggaaggggaggatcatatgtacaatgttttaaggcaaaaaaactcacaaccaaaagcaaggctttattaactttcaccttcgagaagctgcagtgttgagccctgttttattcctagtattactgcctttgatacgaactcttaagtgatcactttagaagttaatgcattttattgactgctttcaagaaacagtctatattgtatcatgcatgtttttcaagcccgcagaattgtataaggcctatatatacatagggcctataattttgacactttttaatgatttataaggttacgatcatgtaaaatcctgttgacacgtgagaatatgcctaagtaccgctagatagcttattttgaagagatagttattttgaagagatagaaattggttgcagtttgttaggtgtatttgtcaatgcattgcctcaatgctttaaagcatatagaagtttgaatatgctttaatctcatgtagtcctttgtttatagggtgtttaatatttttaaagactaaagatgtcacagccccctttaaggttcagtaatattaagattggagatttatagggttagaatccaacaaattcagaggaaaattgttaaattatatagctgtagagcaggaaatgaaacccaggttctaagctctaaggggaccatgagctgccataccaagtgcatcagtgactgggcatagagttggcagaattacaggatggttaagagagtgagctgtagagcctcactctatgtgaacatgaattttatataagtatgtatgtatttatttattttgagatggagtctcactctgtcgcccaggctggagtgcagtggtgtgatcttggctcactgcaacctctgtctcccagattcaagcaattctcctacctcagcgtccccagtagctgggaatacaggtgcacaccaccatgtctggctaatttttgtgtttttagtagagttggggtttcaccatgttggccaggctgttctcgaattcctgacctcgtgatccacccacttcagcctcccaaagtgctgggattacaggcagccactatgcccggctgtgaacatgaatttttaaactgcatggtgctttgggtcccagcttctccatctgtacaatggggacagtactaaggttttctttttcttctcagttgactgaattatttccatagtctgtctgtcttgccactcttgttacccacacgaaaggacctaaggtaatttctgacagcctgggactccttgtgcaaaacagaaggtgccacagacctcattttaggagaaacctttgttttcctcttggaaccccaagaactgtaagcagacaggtccatctcaaaatccaaggctctgctctgttttgctttgctttacctgactttttttttgatttgggtgggcatcaaaaattagtaggggagagctaaagaaagttgtggatatgaacatgtatttatggtaaggtaagttatgaaggagagaaatcttaggatcttgtatggcaaattcttgcactaaagtagataatgactaattaggaaagcaggaaatataggacaagtcagaaagtcataagatgggagagaaaagcttacgcctggtagatcctctcctgtctagaagtgtcgtatgtgtgatgtttatatgaaggagctctaattaattggattaaaagataatgaaagctctaaaattgtcagaaaaatagaagctctaatgccttttatttcacgtgacttcagcaatctttgggaaatgagagttttaaaattattggtggtaaaaagtcttcaaaaagtagacatttggtctaaattaagtcagaggttaaattggctaagtgctttaatgtcataaactgcttctttgactttggaaaattgttcagtttacctaatttggaactgttagatttctaggtaaggcctggggagaggtggagttagccatgtctcctagctatgctggaagagttagactttatctgcagttctgtcatgtatcctggactctgcacctggtatgtaattgaaactgcttacattgaaaagaaaaattatgtgtttttggttttaaaaggggtgggaatatggttttttccaaaaagtgagttttggcaaatttagaaagtttaagaattatttttagttgtaggaaaataaagtttaagcaagttatagaaggtttatgaaaattaactttgtaaagaattgtgtgtgtgagcaagttgactaaagggacagtaatgttagatgtaataaatgcaggtacccttccactttatcttctgtttcttaggttataaatattcactacctacgtttctaaaaactctttcactataatattaacacataactccattctccttgtattgcctgctttttcatagtatcctgaaattgcattagtagatttagattcagaagatggtggggaagcatcttatgagtgttttaagtaaatttaaggcaaagggttttctgtacatgggtggttatcacagcatcacttgttgcagcaaaacactgggtaacaacaatgtttatcaatgagaaattgttcggataaatgatgatttgtgccttgcgaggctcaactattcaaaagcaccctcttttcctcacttgctttacctttggttctgggcctggagcctttcagaggttactcaggaaatggactcctgtttcctgtgactaatctggacagcggcttcctatttcattcttcagcatcttccaaaaatttctgaagataatttcttcctttgtgaccacccatactcttggtttactttgcagttaacaatttcatgccttcactagattatctgtgtgaaggtgtggggtgtatgtgttcatactctggagggagcagaggaaaatagccacagccaaaggagtaatcttgcactaaatactcattataagaatgttgatacgttcatagatggtaaatctgtcagtaatttttacttgtatgattcttggttaagactgcactcactggtgataagcgtgctgaagggatcataggtgctatacttatgtgtgggaattgcattcaaaccaccaatgcctgtctactcaagttttgttgccttttgattaaaaactcttgggaatgtttccctggcatgcaaatatgggaactgcagtttgattctaggtagaaactctttggtagttgaaatgccataataagagacacagctgtcaatgggcaacaattcactgttggtaaggaatttacagtgctacttgccatattcttctttatccagactttgtgccaagaaaatgaaattctttttaaaaatttttttctagagtaatcctacaatattgctgttatcaagcctgatgctgtaattagtagaaaatgtctagaaattaaaagaaaagtagtattttccaactatggttaaattaattgcaaaataacttcctcttaattgtcagattggagacaagcttattaagagtgaaataaaacataatgtgttgctggtgctaggtacctctaaagcctttgagcactttcttctttataaaggctcaatctactcatgtgtcctgtaaataatcctgctctaccagcatcctatgtaaattttaaaaattatagttcatatattagattgtaacaaatgttgttcttctttaattatatgcaatgcaatcttgttatagactcacattagcttgccttattccctgtatgtttgctgtaaaatgtatagtccttttcaatatatgatagcttaaagatggacttaatattttgttttagaaccaaaatcttttatcttatatacaggaaaattacattggaattcagagatcagcaaacatttcctgtaaaggatgaaatagtaactattttcaggtttgctcagcatgtggtctctgacaactaaactctgaagtcataccaaggcagcatcagtaatgtttaaatgagtgaatggcgctgtgttccaataaactttatttacagaaacaagtggtgggccacattttgactgcagggtatagtttgtggacccctgaacaatggctttttctgaaacaacacaattgaattgagatttgaaagaatgttgaggcagcattgtttgtctggggtaatacctgaggtttgtcatctcacaccagggaaatcagggatgtggacacacaagaagtgagttcaagagtggatgattaataggtgaaagaaagagaaaagagaacagctctctctcctgcagaaagagagaggggcacctgagtgggtcttccggttttgtggtgaaaagcacaaggttttataaaggagcttgaggaggtggtgtcttgatttacacagggctctagagactggttggaccaggtgtgaacgtttgcatagcacagggagaagctggccattgcaccctaatcttttattatgcagatgggttctttaccttaccaggaccatattgtctgttccttactgtacctgtggttgacagagaaaagggaagatggagccaccatgttgaacatgcctggcccacaggtagccttttcctattggcacagctgctggcattcctatgagagcttatcaatgtctgcagcccaattttacaagatgctctttgttagaaaataaatgatatgggttttttttttcattagtaggaaaactttacactaggacttccttactttcagtatctgcctaaataatttctttttaattcctacatcaatgttgcatgtgcaatagagaaggtgacatgtagggagctgtgtcagcaggggttgcatatttcttgatgagcatcccatgatgcattcttcttcacttgtggcaacattagcattaactaatctacagtaaagtagatgggtccacaggtcatgggacatacactagctctgccaattacatgttgatttaaataatatcattctctaaggacagctttttttcccccagatcctggtatgtatgtggagttggggagagacaccaaactgtaccccatttcctcatacattgcttatacttttagaagtgtttgaaagataatatcacatactagtagtttactgtttcttattcaagttagttttaatagtcgctagggtgaatgttttcaaaattgtatagatattcgggttgaggcaatactataaattatgagttcatctcagtttttttgtgctagcgtaatgacatttcggagacataatgcatatgtgcaaaatacttcacctctctggaaaacagtaaagggctacataataggacagacaaaaataaaggcttggcgtaatggctcacacctatgatcccagcactttgggaggacaaggcgggtggattgcttgagctcaacagttcaagaccagcatgggcaacatggcgaaacccatgtttacaaaaacgataaaaataagccgggcgtggtggcatgtgtttgcagtctgagatacttgggggactgaggcaggagaatcgcttgagcctgggaggtcaagggtatagtgagccgagatcgtgccactgcactccatccagcctggataacagagtgagaccctgtctcaaaataagtaaaaatttataaaacaaagaatgtttctaactgtaataaaggagaagtgatcaagcttaagtgtagcttagatttaatctttgatttccgggtactatattacttaaaaatatgatttggatatttagaagttgttcaaattagaaactcaggagtggggtcactggtcactaaggtgctgaatatttttaataccttagtggatatgtaatcaacaaagccaacggaaccaatagagcatttgctttcataagaatttaagtgttgctgggtactcttaaatcgagctcacattattggtgtcatttaatataattactgaatttctttgaacccagtttccactttttaaaaattatttagctcattaggctgaaaacttctctttgttacattttattacacttcagtgtaatatgtgtaagatgtacattgcttctctctagaaaggtgagacaagttgaagcagggttgggggtgggtgcttccagttcataggtaaataggagacaaacggttgcattcttttgagtttctgattatcctttcactgaatacacaatttacatgcaagatgccatagaggaatagtcacttatgcctgagtctggcttagtgaatctgcatttttacataaaaaactgggcagagaaagccaatcagatacacatttgtctcaggtgaggagagggatgactttgggttctgtcctttgtcccccacctgtaaagataatctatcaattgccaatttatattgccagggtcaaattcaacagaactgttttagtgtaaagatcttgaggcccacaagaaatttcctttctgacaaattatgagggaggtatatagctttcgaaatctttgtagttatttttttattttattatttgggttttttttttctttattgacaaataattgtatatactcacagggacatagtgatgtttcaatacagaaaagttatagtgagcagagcaggataatttcatatcctttgttaaaggaaaataaatctccgggacaccccactaagccaaataatagttatcttatttagaaataaaatgggaggcaggtttgtttgatggagttcctagctgaggtgggagaattgcttgaacctgggaggccgaggttgcagtgagccgagatcgcgccattgcactccagcctgggcaacaagagcgaaactctgtctcaaacaaacaaagactatagaaaagctatttgtgaaaatgctttttgatgtgctgttttatgtcacagaatgcaacctgtgttttgattcagcaagttcaaaacactctttttgtggaatctaagaattgattattttgatcctattgagctttcataagaaaatatgaatatccagttgtaaaaactagaaataagctataagctatctgtggaatgctttgtgaggtgctgttttatatcataaaattgaacttgtgttttgattgaacaagttgaaattactcattttgtagaatctaagaagtaacgttttggaacttcttgagcccttattaaaaaatagaaatattcagtcctaaaaactagaaacaagccatccgtgcaaatgcattgtgatgttctgttttgtatcataaagttgaacctgtgtgttgattaaacaggttctgaacacttttttttgtagaatttatgaagtggcatttctgagcctattgagcccttatacaaacatacagttttaaaagctagaaacaagctatctgtcaaaatgctttgggatgtgctattttatgtcacggaatgaaacctgtgttttaattcaataggttcaacacattcttttggtagaatctgagaagtgacattcccaaacctctgaggcctttaaaagaaaatacgaatattttcctctaaaaactagaaacaagcaatgcgtggaaacgctttctgatctgttagtgtcacagattggaaactttgttttgattgagcaagttcaacgcactctttgtaggatctaagtagtgacatttccaaacctattgagcccttataagaaaatatgaatatttagtcctaacatgctatctgtgaaaatgctttttttttttttttttggcacagagtcttgctgtgttgccaagctggagtgcagtggtgtgatctcggctcactgcaacttctgcctcctgggttcaagcaagtctcctacgttagcctccctagcagctgggactacaggcgtgcaccaccacgcccagctaatttttgtatttttagtagagatgtggtttcaccatgttggccaggatggtcttgatctgttgacctcgtgatccgcctgcctcagcctcccaaagtgctgggattacagacgtgagccaccatgcctgactgaaaatactttttgctatgctgtttcataacacagaattaaacctgtgtttttgtgagacaggttccaaacactctttttgtagaatctaaaaaagtgatgtatccaaaccttttgagccataataagaaaacatgaatatttagccctaactgctggaaacaagctatctgtcaacacactttgtgatgtgatgctttatatcacagaaatgaacttatgttttgatgaaacagattcaaaacactattgtagaatcttaagaagtgacatttctgagcctattgtgaccttataggaacatacaaacatccagtcctaaagtctacaaacaagctatcttggaaaacactttttgacgtgcagttttataacacagaattgaacctgcattttgataaaaacacgttcccaactctctttttgtagaatctaagaagtgacatttcgaatctattgagcatttacagtaacgtatgaatatcttgtaataaaaactagaaacaagctatctgtaaaaacactttgtgatgtgctattttatgtcacagaatggaacctgtgttttgtttcagcaagttctgaactctttgtagaatctaagaagtgacgtttttgaccttattgagcccttataagaaaatacaaatatccagctataaaaactagaaacaagctatcagcgaaaacactttttgctgtttcatatcacaaaattgaacctgtatactgattaaacagtttccaaacactttttttgtagactcttaagaagtgatgtttctaaggcagtgaggccttatgggaacatatacataatccagtcctaaaaactagaaacaagctatctgtgataaccatttgtgatatgctgttttatgtcagagaatggtacctgtgttttgattcaacaactgtgagacactctttttgtataatctaagaagtgatgtcaccaaacctattgagttttataaaaaatatgaataaccctaaaaacgagaaacaagctatctgtcgaaaatgctttgtgatgtatttttttatatcaaataatggaaccagagttttgatgaaacagcttccaaacactctttctgtagaatctaagaagtgacatttccaagtcaattgagttcttacaaaaaaaatgcaaaatccagtcccaaaaaactagaaacaagctacctgtaaaaatgctttgggacatgcagttttatgtcacagaacggttcctgtgttgattcaacaagttcaaaacactcttgatgtagaatctaagaagtgctgtttccaaacctattgaacttttattaaaaaagtaaaaatatccatccccaaaaactagaaacaagttatctctgaagatgctttgtgacgtgatgttttatgtcacaaaatggaaactacgttttgatttagcaagttctaaacactttttctagaatataaaaagtgacatttctgagcttattgagctcttagacgaacatacaagtatccactcctaaaaatgagaagaaaaacctatctctgaaaatgcaatgttatgtgctattttacatcacagaatgaattttcaaacactctttctgtagaatctaagaagtgaaatttccaaacctgttaagcccttataggaacatatggatattcagtcttaaaaactagaaacaagctatatgtgaaaatgcattgtgaagtgctgttttatgtcacagactggtccctgtgttttgattcaccaaagttgaaacactcttttggtagaatgtaagaagtgatgtttccaaacctattgagcttctataagaaaatatgaatatccagccctaaaaactagaaataagatatctgtgaaaacactttgtgatgtgctgttttatgtcacagaatggaacctgtgttttgagttgacaagttccaaacactctttttgtagaatctaacaaagtgacatttccaatcttactgagcccttataggaagatgtgaatatccagtcctaaaaatgagaaaaaaagctatgaaattgcattgtgacatgttgctttatgtcacaaaatggaatctttgtttttattcaacactttcaaaactttttgtagaatgtaagaagtgacattttcaaacctattgagcccttataagaaaatgcaaatatttagtcataaatattagaagctctctgtgaaaatgctttgtgatgtgctgttttatatcacagaattgaacctgcattttgatgaaacagcttccactcacttttttatacaatctaaaaggtgacatttcctagcctcttgagcccttattggagcatatggatatcctgtcttaagaactagaaacaagctagctgagaacatgctttatgacatgctgttttatgtaacagaatggaacctgtgtttttagtcaacaagttccagacactctttttgtagaatcttaggaagtgacattttctatttttattgagcccttataataaaatattaatatttagtcctaaatattaggaaaaaacctacctgtgaaaacgctttgtgatgtggtttcatatcacagaattgaacctgtgttttgacaaagcaactttcaaacactgtagaatctaagaagtgacattactgagcctattgagcttttataggaacatacaaatatccagttccaaaaactagaaacaagctcttggtgaaaacgctttgtgacatgctgttttatgtcataaaaatggaacctgccttttgatgaaacagcttccaaacaggtttttttttagaatctaatagttgacatttctggccctattgagcccttatagaaacatatgaatatccagttctaaaaactagaagcaagccatctgtgaaaatgctttgtgatgtgctgctttttgtcacggaataatacatatgttttgattcaacaagttcaagacactctgtagaatctaaaaagtgaagtttttgaacctattgagacttgattaaaaaatacgaatattcagccctaaaagctagaagcaagcaatctgtgaaaacactttgtggtatgctgttgtatgttatggaatggaacctgcattttgatgaaacagcttccaaaacacttttttgtagaatctaagaagtgacattttggagcctattgaacccttacaggaaaatacgaatatccaatcctaaaaactacaaacaagctatctggtaaaacgctttctgatatgctgttttatgtctcagaatggtactggggtttcaattcagcaagtttgaaactttctttttatggaatctaaaaagtgacatttgagaacctattgagccgttataaaaaattcaaatattagccataaaaattagaaacaagctagctgtgaaaacgctttgtggtgtgctgttttatgtcaaagaataatacctgtgttttgatttggcaagttcaaagcacttttttttctagaacctacgtagtgacatttacaaatctgttgatcttttataagaaaatatgaatatccagccacaaaaactaggaaaaatctgtgaaaatactttgttatttgcattttatgtcacagaatgaaacctgtgttttgatgaaacaacttccaaaccctctttttgtaaaatctaacagtgacacttatgagcctatggagcccttatagaagcactcaaatacccagttttaaaactggaaactgtctcaaaaacactttgtgaggtgcttttttatgtcacagaatgaaacgtgtgttttgagttgaacaacacacaagtttccaacactcttgaatctaagaagtgacattttcaaacttgagcccttatagaaacatacaaatatccagtcctaaaaacaagcaaaggctatctgtgaaaatgctttgtgatatgctgctttgtgtcatggaatggaatctgtgttttgattcaagtttgaaacactctgtagaatctaacaagtgatgttttgaacctattgagtcattataagaaaatgcaaatatttagccataaaaatgagaaacaagctttttgtgaaaatcctttgtgatgtgttttctatcacagaattgaacctttgttttgttgaaatagtttctaaacatacttattgcagaatctatgaagttatatttctgagcatttgagcccttataggtacacatgaatatcagattctaaaaactagaaaggagctatctttgaaaactatttgtgatgtgctgttttatgtcacaaaatgataaccatgttttgattcaaaaagtttgaaacactctgtagaatctaagaagtgacatttctgagcctattgagcccttagtaaaaaaacaaacaaaaaacgaatatccactcctaaaaaccagaaaaaagctatctggtaaaatgctttgtgttgtgctgtttcatgtgacagaatggtgcctgtgttttgattaaacaagtttgaaacactttttttttgtagaatataagtagtgatgttttagaatgaattgagcccttataagaaaatgcaaatatttaaccataaaaataagaaacaaacaacctgtgaaatcactttgtgatatcctttttttatgtcacagaatggtacctgtgttttgatttaacaaatttgaaacacactttttgtagaatctgagatgtgacatttacaaaccaatcttaagccagttagatactctgatgagccagctgtgtgtgtatgtgtgtatgtgtgtgtgatctttgattattaaaactgaaaaaataatcgtatattcatgactagtagacacagtgttttaaaactgattctgaaagatttgagggttaggcttgttttaaaaacaattgcataggtcctggaaacaccaagaattagtggcttctcattcctagtcacatgaaaaatattttactactcttgtgaatggccataaataatatgcagaattttttctgtgtcctaaccttttatataattggttctacagtgtacatcactgtgtgcaactttgttttgtgtgctcagacttacattttccagttttctccactttgatacaattggtctgtgtttcatacattttgtattttctatagcgttcctttatatgactctaccacattttattgagtctcctcatgctgacaggtaagtagatgaattaataaatgaatgaataaataaaaatgagagcaaatttcaaacaggtgattaatttagtgattgtaaccatggactcagcaggttagaaataaaaactgaaagatttagaatgcaagcaggcacatcataccttctaatagccattggaactatgacccacaaaccattagcctagaatgatgggacatatcttgtctctaaaaaaaggtcactgttcagttctcaaagaatggatataaaaatggcagataccattccacattattctacttcctttaacctctacgcataaaacttgagctgcagggaatgttacctcctgttcttaaaaagacttgtagttcagtgaggaactcactcctttcttcattcatgtgttcaaataatatagggaaatgaatggaaaagtgaagagaagttgaagactattatggggatagcacaggattagtcagcctcatggtattattgatctgccttattccacaaatatttaccaagcacctgctacatgcaatttgtatactaggtgctggggatacaggagataacaaagtccctgctgtcaatgaaaggggtcagtcctttgattcatctttagttaattttaagcacacaacaactatctcaaactttcttcacactttccaagctcccgatccttcatgcactcttggtagatgcctgaccttacctcttaccttactagaacctaagaccacctggtataaaatcccttaagcacactcagatttgcgtgattttacaatgatgtctgttcccaaagcatcctcacttctcttggagctgagggtgaagagctcctctttcttcccatccgtgatcttggaacatgtacgactacacttgtgacagtaaatgcttaatacaggcagaaggtttgttccttatttcctccctggggcctccctccagtgaatatctcttctagcattgtcagttgtatccaacagaaaagcagagatctctccattggtccaaaaacctaagatggactctcactgctaaacttctcaaatgaaaattcctccactttagtcctgattaccactcaaacactgttagactgggcaggtcactacccctgcctagttctgtttccccatctacataacagagaaataattgcgccttatctatcctacagaagtgtgaagaggtttgatgtgacagcagtgaaagcaatttaaaaagcacagagtgctatacataagaagacattttcataattattccgctctaacatgatatctgtattcatacgatctcaaagtacttacccaagcatggattctaactcttgtgtatgtaagcaaaggtgtaagtctgtcaccctccatgcaaatagaatctcccctcccttggcccctgcatctcaccatatacaggaattaactcaagatgaatcaaagttttaaatgcaagaccgcaaactatgaaaatcctttaagataacctaggccatacccttcttgacaaaggctttggcaaagcatgtgtatgtctaagtccctaaaagcaatagaaataaaaacaattattgacaagtgagacctaatacatgaaagagtggctgcacagtagaagatattaccaacagagtaaacagacagccttcacaatggaagcaaatgttcccaaactacatctgacaaaggtctaatatgtacgatctaccttaagtccttaaatcagatcaaaaagtccaattaatggttagagacatgaatacacactgctgaaaagatgtaacagccaccagtaaacatgaaaacatgctcaacctcgttaatagagaaatgcaaatcaaaagcacactggtcaaaatggtgattataacacagtccacaagaacagataccagcaggacagaggagggcactggggcaattgatcatgattcttatggatagtcatttagtgttattaatgaatttcataacaaaatgatcaccatacaaaaaatacaaaatgtgttttcttccctgagaaaggaaaataaaaacttggaatgccgattcactatgccaaaaggaaaagttaagctgaaagctgagtcatgcaagaaactgcctttctttttttttcctgagcagacagctactgataaatagttaaatttctccacaggtagctactctatgttcatctcatcttacttaaagtgctgatttactgagcaggagaaaaatatataactgactattcctttacctgtttgttttctcttgcaacatgtggattcagcaacgtgaccatactctccctcttttccccgcagcctgcttttctcttctaaacactgaaaccctaaaatatttttggagaaaggcacagacctctgtcgcccagccatgtctttaaccttggaagaagaaacttctaaattgataagagatctgtctcagacactttttcgtttacatcccgttatctcagaaagcaaaacaggctttgttccaacccaaagtaatttgtgaatattcaagcggtatcattctgatgtaaaatttacataaattcttgggtttaccaaaatgcaaatgggcaagcagatcactatttacagataatggcctaaaaaatggtaagagtaaatgctgtggagctaaatgtttctgagtctgccatttcctagttttgtagtttctctcgggcaagttacccaaagttgctgtatgttattatcttgacatttaaaatagaagtaataactttattataaataatagttaataccatagggtcattaggaaagtgtctggcatatatagtcacaacccagtgaatgccattattgtttttgctattatcagtataataattgatactaattttgatgctgaggtaaaataatatctggcagcttttaatttgctaatgttaaataactgaaaatagctttaaaaagtgaaaatatccaaatcaatgacaatatttgatttatataaaataagcttcattttttttagtttttttgctcctaattattacttcactcatcacactgatatctgagcactttttaaaacatatccacccttctcagttgtactacttattcccttttcttgtaatcccagccttcaaagatcctttctcatttttctaactcatttcacgactccctcaccttgacccccagttatatctctcttgaagtcaattccattgaattgactacttggcccaaacttcaccccaactcagtctctcttcaggaaggaaagtccccacacaaaaaggaatgtgtctttcaactcatgcgccctttttgaagaagctttccagacagcttccttacagtgatctccgttatccatcctttagatcgctgtggagtcctacaggggcgcaatgtggacagtcattcaaatgaagcacacctaagtgcttgcattttctaaaggcccattgattcatgtaactcccgtacttgcacagataagatgttcctgcctgaatgcagcagatggaaatgaaaattgtattctctgtcaaggctgattgtattacagcttaatgatttgcattttaaaacttggaagttctcataaatattaaagtgaaagaacaattggctacattattaggtaggttcggctgttcgtataacctggtgctaactatctaacctgcctgagtgagcctcagtcttcattactgcagcatttgtaagatatcaatgcctgcttgaactcatgtcttactaagattatggccaggattgagtaacatatggatataaaagcacttgacaaatcagagtatttcataaatgtaataataatatgctacatttataacatctatactcttttcctgtgtctatcttcatttaaaccttgcagtttctatcataatcaaagattttgtaatcaggttacaatgagtaggatttaacccataagcaattttcaaatttcctagatatgttttcagttttcacatttatgttggtgacaaaattctgttttcagttttggtgtttgcatcttctaaaacagtgtcttgggtacttgctctttgatgagacactgtgcagacataaagagtgtaagaaaacagaacagtttatctcagctttttgtggtctagataacctgcacactgctttcttggctcactgcaacctcctcttcctgggttcaagtgattctcctgccttggcctcccgagtagctgagactacaggcatgtgccaccacgcccagctaatttttgtatttttagtagagatggggtttcaccatgttggcccggatggtctcgatctcttgaccttgtgatccccctgccttggcctcccaaagtgctgggattacaggtgtgagccaccgtgcccggcctgcacactgctttttaataagctgatctgtcttcttgtttacataggctgtgctatagtcatttaaagttcaaaattactgctaaaaagtaattaatcctttactgaaatattcctgctatttcatgagctgtcttacaatttggaggaatctatttgtcactgatgtttaaaaaagaaagtcacagcagggaggctttagcttcattgaggaacattattataaaataaaatgatcgagggtaatttttttttgtccttgtggtactgtttctgcagatctacattaatctgagcatttaaagtaataataaatttgttatatcctctttattattcacttcaccatggtagcccctagtggtaaaaggagatgtaaattgctcagtgctcacattgcagggaattttttcctcagttgaataaaaaggagttaagcctctttggaaatgagggctatagcctgtcaataactacatatattcctgtttttaagaaatcagaattctggtgtccagtaaatgtagatgccagcattattaaaaagtgattgagcagagaaatgaattgaatttttgacccactctggcttccagctttcatgggagcctatacagggggatgatgaagagggatataagagaataaatgattgctctattaatctactttaattgatactaaaatctgacagcgaattacaagttccaggcagtaaggcttaccaattcattggtaatttcaaggttctactttgctttctttttgccttcagctccttgcaaaggacacctttttttttttttttttttttgagatggagtattgctcttgttgcccaaattggagtgtaatggcccttaacatccgcctcctgggttcaaatgattctcctgcctcagcctcctaagaagctgggattacaggcatacatcaccacgcctggctaattttgtatttttagtagagatggggtttctctatgttggtcaggctggtcttgaactcctgaccccaggtgatttgcctgcctcagcatcccccgcccaaagtgctgggattacaggtaggagccaccacacctggccaaggacagccttttatagttcagtttctcagtttatctttgactattcttaattaagcttgacctggttctccaccactgacgctattggagttgcaaagcattttgctgttataatgatagctcccttgatggctgttcattattaactggttttcaaaagtgctgcttttaactttcattttataaatatttaactcaatttttataaaatgtgcatagactatagaggttctgcttacctgtttaatacagtaaaaaaatcccttttgtaatcttatataatattaagaatgtgtccttaattcatgcttaacataaattcttacacaactagcagtatctcaaaaaataaatgatttaatagtttatgacccttatacatataattaattgtagtaaaatatcttagaaaatagaatgagtattttttataaagataaaaaatcctgatttttttttctggtcttaatataaaattaaatgtgttaaagggaacttataaattacatagtagttcattgctcaggaaaagaaatgacaaagtaattaagagtgtaaaattaaaaggattaatttttcttaaaggccgatgagttaacaacacgcatcaatctctcttccttctccaaacttcagacaaatgatggcaaagtaatttttaagaagtcaatttatagaggcaaaaaacctgaagtacagagagtaggaaagacagtaatagaattgagagcagttgacatccataacattcctattattacctccattttctggataagaatatggagaagaggaatcgttaagcaatttgctgattgtcacatattcagtaagtggcaaagttagtattgaaacccaagtagtcttgttttaaagtcatacactcaatcactgtgccataattcaataaattgtgaaggatgggaagcagatggagaagtgattgatgaagcaggactgagaaagtgctgcctatgtgcccacagtgtgaagaccctacaagacatcagaacatcatccagtgaagctgtgagcagctcaccacttggaaaaactgagtgttttggaaggcagggataaagtgcagttctgaaaagagaaaaatccatcaagttctaaacggtcgcgctctcttaccccacagtgggcaatggtctctccattcatcattttcttttccctgagtcccttgaatcttaaatatactattctgtgaattaaacatggtaaacattagactttgaccagcgctattatcagaagttcacatacctaatcaaaggacctgtaaccttcttcccctccttagtttctacaccaccagtagccaattatactatcccagctcccatcctaaaatccccttctaaaatagaaggcaaaagatcatcagtcatttgagcaaaatttcagcatgacagcatgagtagttgagacctatagtaacaactaaaatggactgggataaaacaaataatgtttggaatcaaagaacaggaaaaatacaaccgatattggagcaagaaaaaataaaaaagaatatgaaaaatagataagaaatagctattggaaaggtacaagaaatacaattttaaaaccagtggaacataagacaaaccacaaaatgagaaaattctattaataaaaggtcgggggtcggggaactgtattctttttttttttttttttttttttaagacagagtttcgttcttgttgcccaggctggagttgcaatggcgcaatctcggctcactgggcaacctccaccttctgggtttaagctattctcctgcctcagcctcccaaatagctgggattacaggcatgcgccaccacgcctggctaatttttgtatttttagtagagattgggtttcaccatgttgatcaggctggatggtcttgaacccctgacctcgggtgatcccaaagtgcagggattatgggtgtgagccaccgtgcccggccactgtatcttttaaaaatgtaattgtcatggaaggcaagaaaggtttaggaggctttccatattgaagaggactgaggagacatggcaactaattgcaatacatgattctagactgcatgcaatactggaggaaaatcatgctataaagaattgactcaattgataaaatcagaatactagcagtagattacatcaaagtatcgtatcaatgttacatttactgaatctgactaccatactatagttaagtaagagaatattcctatttttaggaaatacagaagtgtttagaggtaaagggtcatgatatatacaacttaacaaaagacttagacaaatatggggtatttaaataaaggagaatgacgtgcaatctgagaacaagaagtccaacagagaaaagcaaaaatagggagtcagcgagcaaccagtgagatgggagcagaaggatggaagggtggaggagtgacatctaaacatattaagaactcaaatatgttgattattttgtatatctgaagtttgaaattatcactgacaatcttctaaacttcaggaaaaatgaggatactgtgctacaaatgtaaacttaagaacaatatttacatagtcatcataatgtaattatgaaatactgatttcaccaaaaccaatttgatttaacacatcgagagaacagtgggaatagagtcctgtaattggtgcacctgtcctaattcctatgtaggtattataatagaaagttaataggtaatgtttaaaattgataaatcaagataacaatatcagcatgttaggttaaaaacaaggtaattaccaaaagcaccagataaaagagccaaacattgctttctctattgaacgggactacagcatagagaagtgttaagcaagctgccattattcttttgctcttattataagcctcttaatactatttgattactagctcatgagctcctatttataaaaataaaagcaaattttcgaagtcagaacaattcatgctgctacaaaatccctaaagtcatttcaacaatacagcacactgatgattatatagacatttttcttgtctgagttctttgtctagaaactttttaaaagaaacgtggtcctgtattacatgtagcatgctttggaagaaaaactatctccaatcaaaaagtttttaaaagagcccagatgttatcgtcctttgtatctctaaaagcaattgcttttataaaattaggatctactcttttttgaaatttgaatgctgaagttttgtgggtttcagcaaaagataggcataacatacatctctacattttattaaatatgatggtgcagatgttaaaaatatgtttgaaatgcagtaccttctgttcttgctttcaactcctaccctagagtaaatgaaatgctaatcacctcttgtgttagtgatagaatttgtgagtttccacagataaaatatgtttactgtaatttccaaatagttgatagccagtagcaatatcttgacttcagcaactggtatgtaagggtctatattaaagtgtttatattatgactagtataacagatggtattatttgttacagcaggtcataacactaaaaaataaaactattacacatctacaatttgatcacaaattttagtggcagtgatcacttattttatgaaagagaggcagtaattgccgaagtactgcctaaaaatgtaagacaattctcattacagggtaaggtaaaattattgacttattaaccagaaattcacatctatcccgctacaggaaaaaaagtgtacatttaatatctactacagtcagttgagttttcaaagtaatctgtcatctctaccatgaatatggggaacaggagaataactgctggatttttggcatttgacacctaatatatagaactttaaaggaggttatctattatataaataatctttgaagaagagcaatttatgtttttggacaaccaaaaaattacttgtttagcttcacaggaattttaaagcatgttttcacttattattaaacagtaacattgaatatactgctcttttatcagttctcatttttttcaacattcagtagatgactttaaagaactctcaccttcctggttttctttctaaactgagattatttcttctctcacttatgcacctattttctaatggccatgtctcaaaaaatttttattctagcgtcttttttccttttatcttggttttgctgtagtgctagatagatggttacttgtgagactttcaaatctatataccaggctccaacttctctccctctccctctctttttgagtaagggtttggctccatcacccaggctggaaggtcatggctgattgcagctttggactcctgggctcaagggatcctcccacctcagcttcctgattagctgggactccaggtgtacagcatcatgactagcaattccattgtttttagaaatggggtcttgctctgtcgaccaggctggtctagaactcccagcctcaagcaatcctcctgcctcagcctcctaacgtgctaagattacaggcgtgagccaccacacctggccaacttctaagtttcagtgctgtagttttaaattgtttctcatacttatctaatattttttcccaccatgtcaaacccttaaaaactcagtatggacaaaataaatattaacttttttgagattgataattgtatgatagtgcttattacctcaaaagaattactggggcagcagtataatccagtagatgggggaaatagtggatattaagaccgaaatgggatcataactttttagttgtatttgcccacattaattgttttaaagggggtaaaggcctggaatatgaaaacaggaggatataaaatatatggaggttgtgaaagatgactcagaacttgaaacaattgtttcactgcagtaaatacatgttgaatgcatagaacagagaaaaacagaagaaaagaagaaggaaaaacaaactccatgatttaaaatattgatgaatgtgacaataattgtatctttaaaataactgagaaatggtagaaataaaaattataagcttcaactgtatattacttattcttgacaaagatgatagttgcaagctgaagccaaaatttctaactaggactaatgcaaagatttcaagagaaactttaataaagaattattgatgcaagcgctttcagaaagcaaaggtagggactaaccattagctcttgtttagaaagataaaggtcacaaataaaatttgtgttttaatctatacattttcagcattatgtcatcataaatttgcatgttgtttattacaaatgggaaaaggtttcctgtaatatatcaagatgagttttaatagtttcaaggaccattgatttgtaaacttaagactattatagtgttgtggaaaattaaatataattggtgttttaggaaaagttgttcattgaagtttccattttatgtgccttaacagattaattttgcttattaattctgtgatatttaagcactgctgtaagcttcacagatttggcaatagccactatatacttaatgagtacaaactatggagtatttccatattaaggtagaagaaatatttaaaagcacttctacttgtgatgtcattgggggtgcaacacaatataaagtacgcacattgctggaggagaagcataaaataaagaactcacggggcagaaacttaagacacacctaaatcaaatctttgttttcagcattatctttcattactattctttgttacaaaaaaacattgctatctgtccttttctatatgttctctacattaaaacttattatttgtatacatactgttccctacatctgcagtgccattcccagctcacatatctgccctcttaaatttatatcaaattcaactcccttcaaaaagccttctcagttgctttaacccaagccagtagtctgtcttctagaaaacagttgatgccgatgcctccttttcctttagcaactgaaaataatattatagttatttaatgtgtgtgtgtgtgtgtgtgtgtgcataacatcatactatttagtagtatctatatctatcaagtatctgctacagtggatgatagatgacttaaagacagaaatatgttattcatatctacttctcacaggtctagtgctgttgcaggatattttttaaggaatcagagagactgatggggttcaggaggatatttattatttaggtgcaccagcccagtcggattaacatccaaaggactgagccctgaacaaagagttaagttaccttttaagcattttgtagggtgggaggagatctgtgcagggggaagcatgttagagaagtgagaaacaaagacagttattcaattaattgagaaatgcgttacatcatttcttacttttcaaggaaaaacatgttttgcgacttttgtttatgtgtctagtgactttgcagctgcccagctagggaatcagggtcttcacaatgcctgggaatggaggggagagaaagctcattagccacagaaaaataggccgttagttttttaaaggactctagctctttctctttctcagggggaattggattttcttacatacaactgaggttctgcttacacattctttaatttcttttaattcctgttccagtgcagtgcaatgttcatagtagatgcttaatattttttgaattattgtatctttagtcattgcgagccatcattttgagagtcagtctcattcttttagccctagattatttttattttcttgagatacgtgaataaagggcacaggaaaaaaacacagttgagagttttggataatagtaacctaattcacccagattttacttcatattggttggaactctaagttgggtgcaactaacatgagacttgttttgatttattgtaaacatattcttgaatgactaatgaacagtgcttcatgtgaacaaattttcaccttctgataatttccaatattacactttgaaaaacattcccattgtagtgctctagaaaatataatttcaattgttaaaattcaatattactgtaattgaggatattaaataacttgttgttacatgatgctagctgcagcttaaatttcagatcatgagtgttgttaatattatatagttggaattagttctgagatcaatgaatcaatgctgtcttactgttttgtctttaatttttataccacatttattttgtgagtggatttcataaaaggaagttgctttatgttgccaagctcattatcttgggtttttgtccagagctgaattccctttttcatcaaaggacagagagagcccattataaactattgagtaatgctgatttgatgggtaggccacttacctttaagtggaaaggaggccaggcgcggtggctcacgcctgtaatcccagcactttgggatgctgaggagggcggatcatgaggtcaggagatcgagaccagtctggccaacttggagaaaccctgtctctactaaaaatacaaaaattagccgggcgtggtggcgggtgcctgtagtcccagctactcgggaggccgaggcaggagaatggcgtgaacctgggaggcggagcttgcaatgagtcaagatcacaccgctgaactccagcctgggtgacagagcgagactccttctcaaaaaaaaattacacaaaaatgttagactaataaatattaataaacactaaaggaagaaatttagtggaacatttatcagaggcaacagaccaggaagttatagttaccctgtgaaaaggcatcatctaggattcatagaaaacatttgcaaattggcaacaaccaccaccacaacaaactaaaacaaatgaaagaaatagacatttatacagggaaaatataaatagataataagtgtaataaattttgtgactttccacttgaaaacaaagaaatggaaataaaacctatgtaaagaagtggtggagtgagccgagctggggtgggaggggtgggggcatcccaggcagagggaacagcagatgcaaaggtctggaggctggagcaggctgtgaggggtgagagcagcaagtacatgaagtctagaccacaaatcgatgcttcaccctcaaaaatagcctctcactggccaccactcaggcccagatacatgtgtaaggtgggcagccttcaggaaaagtgaccgcaaaagtgcaccacattgggaattctgaggtgtttgagaaagttatggatgaagggtgaggtagactctagtggggaatgtcctcttgccacttggacttctctgtctatttcatgggctattatcaacttctaaagagccagtggtttgggtgcacatttaggtgtaagtacctcttgcctcaagccttaactctctttccaatgagtcaagtgagctgttgtgtttaagtaacttctctttattgtgaaatctttcctatcactttaagaaccttcttcttcagacccaagtaatcccaaggcacctataatgtccctcctggagaagacaaaagggtgtcttctatttctgtgtggcccgatatttcagggcccctaaccaggttagttcaaggtgctcagcataaccatgaatctgctacccatgtttctcaggtgggtcataggccctggagggattgtggctgtggaccaagcagggggtgctgtgggctgttctgagaaggagggttttggagtgtccaagctgagaacatagaggccccagatgttgtatgagtaaattttcatctgacagaattatattttcctaactgaaaacatgaaacagagatgtaacaactgtgcctctttggctctgtctttgcatgctgtcatcagccactgaacaggagctgagagggaagacataaagaacagaaaacccatgagggggatggtccatgtgggtgtggaagtgagggtgagtggggatttggccaaagaggcctaatccacaggagtagagtctcatgtgtgactttcagaatgagcaggagtgagataggtggagggggagtgttggaacatctcatcagaggtgagaatccatagaaggagacactggtcattacagtcagtgagaaaagtgactttagcctgagcctaaggtcattggatcaaggaaggggccaggaggagctccttgaagggaagctgtgagcttgagaggcaggctgaggcagatcagtagaatgagcccccgagaagggctcacagagtcactgaaggactgtgaggtggcagggacaagctcacatggcctttggtcagtgagtctccagctgtaatgagaatgaaatggggaagatctgggacaggaagacaagctgggggcgctggtaccatcatggggagatgatggtgggtggctctaggttagttagagttggaatgaagagcagaaagcagcttcgtgatacctttatgtcataaaatacatttggcatggagaggacttggactttgtgcatgaaggatatggatgtttctaggctgactcccaaatgtttctaggctgactcccagaaactaggatgtttctaggctgttcctggctgagaatttggatggtaactatagtccaaagaaacaaagaacactgaaatcatatcttattttttttaactcacaaaatagaggcaggtagatatttatatgtgttttgttggctcaatgattttttttagtaataaacatatttacttagaaactactgggtgtctgtatgctctgggatttttttctcctgtcctgatgacatctctttcctttctctgggttcaggagttacttcccaggttgtggtgacacaggaacattcactttccacaactcctggaggggcagtcaccttcacctatggctccaaaattggggctgtcatcagagcatctcgacagctgggcccaacagaacatctggcaatgtccccagggcaatggtgggcacaagcagtcaggtcctgggacccctgcacaatcccctggttctcttcatgaagaaaaagccactctggttataatgaggactagaccaagaatgaggcccagtgttacatgctcggtgtggtgatctgaaatatcaccacagggacaaatacaaaaatacaagtgggaaactacactcaaacccttggatcaagcctcagtcctatgcttctgaagcaaatttcttgtttttggagtctggttttcaaccactgtagactcagatcatttattcttcaggcccccaatgggatcatcacaagcactttttctatcaatcatggcagtcacttgagatcaaaggtgaatttcttcttcctcaagttataagcaacactttggcatatttggtgaacttcaaagaaaatggctaagatagaggatgagagacataagaggcttcaggaatatttcagcagatgcaaagcagactacagggtaactcatttcccatatgatttgattgattgcaaaatgtgaaattaaatgcatacaaaggggaatgtgtgtcatttttcctcttaatgacaaagtaaaaaaaaagcaataaaacaaaaacaagcactatttcatgtgtcttgataaacttgtagaaagtcttataatatccacaatatctaggatacagtaaaataactttccatatgaagaaccagaagaacacaacttaaatgagaaaagacaattgatagacaccaatactgaaataatttaggtgctgatgttatgtaactgagattaattaaggagtaattatacaattccttcagtgagcaattttagacattattttttgaagttttaggttcaggggttcatgtgcaggtatgttacgtaggtaaacttgtgtcagaggggacattcttgaaacaagtggaaaagaagcaaatcccgaaaagaaaaataagtcatagaaacaaaccaaattaaaattagaaaacagaaaaatgcaataaattaaaaagaacagtctggagggactctggaacaggtaacagtgaaattaaagttcaggcattagaggaattatttaccgttaagtagggaagaaagtacaaacaatagccatctaagcccagcagagggagctgtggatcttctcagaggtgagcaaggccggaaatgaactcccggggctctcatttatggctcctgggtccatactcactggcccgaattggggtttagagcaggtgctttctcccaaagggcaaactcagagttcccagcagcccatcctccctgacagagcggctgctgcctggctgagcactcagaacttagggagccggtggttttggtagaggccccatgtttgcataatgtcctaaccaaacacacatctacccggggaggtgacgaggagttagaggaactgtcccagggtccagaagtagccgggggttctggggatccttggaaagtccacaccatagcttggatgtctatcctcccctctctccctcctcactgcccaggttcatgtagatttcaaagacaggactttggagggatctgtctgctgtgattcctcacacataacatgtatctgttttagtttcttggttcagttctcaggctgtggtgactcaggagccctcactgactgtgtcctaaagagagagacttattctcatgtgtggcttcagcaccacagcactgaattcagcagaagcctggtcaagtcctcaggacattgatgtgtaacacagataacaaacacccctggatgcccacttgattctctggctccctcctgggggaaagctgccctgacccctcaaggggcccagcctgaggatgaggctgagtatactgtgggctacaccacagtggtccttagcacagtgagagacccagatggggaagcaggacatgaacgagcttttggctgatccggggtacaaacatgaacgtaggatatcaggatcacgtggccagacacctgagctctcaaggacacctaaattttaactatccgtagagagaaaggtgggtggagaggtgtaaattgattcctgtatctgtttgaattttaaagtggaaaatatttgtgaatcatttgggagatgcagattcccaaaaagaagaatttatgtttatattccaaacagaacagtaatagtgagatcaactctaaagactaaggtcaaacacacttcatccagaaagatggatctcaaaagattttgttgttgttttgcctattaaaagctaagagaggaaattatattaataaagtttatttcatgttctatgttaatagtgtgtatttcatagctttttaagcattaaaaattataaaagtgttaagagggattctcttctctaatgttatataagaaagtatccacctaggaaaatattttgaaggtctaacccccagtacttctaaatgtgaccttatttttaaaatagtgttattgcttatgtaattcttaggatgaagccatcctagagcgaggtggcctcttgatccaatgtgcctggtgtccttataagatgatggtagtaaggagattggaagacacagagagaatgccgtgtgacgacgaaggcagagattgaatttacacagctgcaagataaggagcactaaagattgctggcaaaccaccagcagccagaaagagggaaggaaggatctcccctcaggtatatatggaaacattgccctttctatgaattttgggaggctagcctccagaactgtgagacaatacatttgtgttatcttaaccaaacttgtgtttaatacattctgacagcagttctaggaaaccaatacaccagacaataaattacacaatacttctgaaattgattgtacttctttcattttggcaaccagtttttccatgaatatgattatatctgtgctcatatttctaactttataaatatgcttgtaatttaaggttaagataagaaatccttgtgtcttaaaaatccctaaatatatgagaactgaataataatattaacattatgagatctaatggaaaattgtagcttttacataattccacttgttcactagtatcaagatgtgaaggtgggaagatcaccttgttattaacaaaacactcctggtcatctctgtggatttgagagtgcagggggagacacctacatattgtttgggaagtcacaaatgcagcatgcccagagcatcatgtacaacagtgtgagtttgctggacatgtgggcaggaagcagaacagactggggcatgaggaaccacctatcaccaaacccaccagcgccttcctccctggatcagcccagagctgctcagacttgaatgtgcacatggatcatgtgggatcctggataatgtggattctgatcagtgggtctggactgtggactgaaattctgcgtttctagaaggccccttcttccaaagatccacatacatgttttaatattaccatattcataagaatggtgggaaataagggaagccactttcagacagaaaccaaatagaaatttatctgagagggagctaaaggattatgatcaaagagaaatccccaattccaggcagggagctgatcacagagggcagatgggaagttgggagaggttctatttttttttttttaagaaatagaaatgaatgcaaacacaactcaaacctcctcttgatccaacatccctgctggctcctgcccaatttctgcactggcttcttctccagtcttttcccaagcatggaccctcctcaccctctctgcttccccatctcaaactcacaacttcccttctcagttctcctgtttctctccctttcattccacttccttcttctctgtgacctccttagacaatcaccaaaatatttctagaagaaaagccatgggtatttttcatcttttcttgaaagttgtcactcacattccctcttcgttcttcagcctctcttaccccttactacaaaagatgcctgaggccactgtttctcttttccatcccctcaaatagcttctccttccaacccgtttctctcctcagttactagagcattcagtgaagcactcagtcaggttaaaggatcctcccaaatgctcaccctgctctctatgtgtgatctcctgaagaatcaagtagggagagaaacatggcttcatgagtttgtggggaagtgggtgcatggctgaactgtccttgttctcagcaaatgtactttatttcatgcacagtttgtatatgagacaaccttctcctgcggactccttataaaatgggaagaattatgtgttgtgttttcacagaggaagcccaaatattccatgctcatgggtaggaagaatcaatatcatgaaaatggccatactgcccaaggtaatttatagattcaatgccatccccatcaagctaccaatgactttcttcacagaattggaaaaaactattttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctaagaagaaaacctaggcattaccattcaggacataggcatgggcaaggacttcacgtctaaaacaccaaaagcaatggcaacaaaagccaaaattgacaaatgggatctgattaaactaaagagcttctgcacagcaaaagaaactaccatcagagtgaacaggcaacctacaaaatgggagaaaattttcacaacctactcatctgacaaaggggctaatatccagaatctacaatgaactcaaacaaatttacaagaaaaaaacaaaaaaccccatcaaaaagtgggcgaaggacatgaacagacacttctcagaagaaggcatttatgcagccaaaaaacatacgaaaaaatgctcaccatcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcttcagggagctagaactagaaataccatttgacccagccattccattactgggtatatacccaaaggactataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaaggatgagttcatgtcctttgtagggacatggatgaaattggaaattatcattctcagtaaactattgcaagaacaaaaaaccaaacaccgcatattctcactcataggtgggaattgaacaatgagaaaacatggacacaggaaggggaacatcacactctggggactgttgtgtggtggggggaggggggagggatagcattgggagatatacctaatgctagatgatgagttagcgggtgcagcacactagcatggcacatgtatacatatgtaactaacctgcacattgtgcacatgtaccctaaaacttaaagtataataataattaaaaaaaaaaaaagagagttaaaggctgagatgaggtaggaggctgccctgaggaagggtctcatcctctggcatctggtcacagacacgatgggcctgggcctgggctgcagagagcacaatggggctgctggtgggggctctgtgcggctctcagctgggaaataaagtccatgaactttgttttgcctcacggctcactggggccagcagctgggtcctctctgggtgcttggggagcttcaggccaagctcagcccaggctgactcctcctagtagtgtcacccagccacagaggctgtacacaggcccagggagagttaggttaagcaggggaagaggagcacatttgcatgaagggcccctccctctcctttgaggctagagggtggataagagagacctgcagcgtggctgcctcagcagagctctggggagtctgcaccatggcctggaccccactcctcctcctcttccctctcctcctccactgcacaggtcaggaggaccctcagcatcctcatgccccagctcactgacaccatctcccaaactcataccagaaatgttgtttgctcttgtccttccttcaggccataatgagcgtctctgttttcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcacacagtgatacaggcagatgaggaagtgggacaaaatcctcaacctgctgaggctattgttcagtgacaatttttaattttaaaacattttctgtatgtaaaaaatctatctggatgcatcctctgatttagaacaattttactcacaatttcccatttaatgtttcagaagtctcagaagaaattaaaacataaacaagaacataagcctcctgatgacactgagatgtctgcttatccttatgggctgataccaaagtctgtgaagctcaccttttctcttgaaagaaaaaaagaatgagccttcccttgagcaaatcttgctcagagcccaaacttcaagcccacaaatggacagtcccctgcagcatgggctcttgttcttcaaggggtcaatgaggagacctccctttcccaccccaggtgtctgtagtcagggctgcctgatgttccctgcatcctgggactaggcactcaggtgtgtaataccccagaggacaggcctgggagtaattccaaacacagagctggcctgattcactttcaggttcctttattttaagttaaaatgtcaggatagaaagaagttgggtatggggttattcatgaaactgaggccagaagatgtctttgtgggctgtgagagggtgacatggtggctccaccattgctaggggaatgttgagtgagctcctaagaagtttggggaaatcggtcttgtgagtgtggcttcccttcagctcattccactcagaaacatgaggacacccatgggtggatttttctgaactcacaaacactgacttgtgtcctcttttttcttatcccattggagatattcagtaatctactctgtgagatggggtctacaggagatcatggagaagaaactcttcaacctgtgcaagtgaaacttccttgtgtgaagctcttgatgtgtccagattccaaggtcaccttctcctgcacaggggtcagcagaaacattgaatattaccatggaaactggcccaatggctccagagaaatcctgaatttgtgactgagaactgcagtaatcaaccttcagggatctcagcctgattctcctttttcaacttgactttccttgactgtgcagcccgagggtcaggatgactatcactgtcagagctgaatacaacccgatgctgccatgagctcccattccatggggaagtgacataaacatctgtcctccatttcccccatcaaatccgtcactgccctgtccctgcctgtgaccgacacctgctcaggttgtggattctgctgtcacttgtgattccagcaagtctgatgcttttaacttggtgcatcattattagggaagccactccctctaaatcctcagaagatgcccccaaggagttcccggatcccaaggtgcaggatcaacctcccagtaaggaaggctctctgggccccatcactgttcatctgttctactttaatcctaagaaccttgagccttcattatttcccctttctgcttatttggctggaacgttgctggaatgcatctcagttctttggggactagagggataaaaagcacagcccatagaaagctttcacctggttaagtagcatttcctaagagccacgagggcatctgctcactgctcactgctcatccttgcatcataatgggttcctggaccctgggctctcctggctcattgagtttaccaatccctccacactccactcattgctagggctggctagagggaaggatagtaattgtccaatagggagatagttttaggggggattacagaaactactccccataatctttgttgataacatcttcatcttgatgtttgctccccaggatctgattgtgacagtggaagtctgacacttgaagaaatgtaggtttacccttctgaaaggcctggccctggcttggcctagggctggaaggaagaggtgctgagctttgggcaaccaaggcacagctgtcaaggggctgagctctctgcaatgtgggcctcctgcagagacatccctagggaggctgagacctgacgatgatgcagaaaagcaaattgaagtgagcaggggatggtctgtgggggaatcagatgacaggtggggggccagatgtgatacagatggtgcaacatgaagaaaagtgtcttttgtgattgttctgaggagaagggctcagtgctagagcagtgataatgaggcaggagctgggtcctgaagccacaggggaaccaggtcttgggtctttttctgagggtccctagggaagatcacatgacaaccaagtcccatgttatatgtccagtgctcggtatcccagatgctgtccctcccagagcctctgggtgtcctcgtcccactcttccctgtgatctgttttcagctccaggagcaggttcatactctgtgccaagagtggggcttgcatggctgagtggagaacagatttgcaagaagatcccaccttgcagtctggctctgtgtcctgggtgtgggtggtaactgaggagatgtaggcatttgggctccactagagaccacagggagcagagctcacaggggctccccacaacccgggctcctcccttcatcctcctcccattgccttcctcactggggttcgggccaggggagaacccagggctgcttcaagggccctgctctgcaaccatggtctttatccaagtcattgtctccaaactctgtaagggctttctctgaaactgtaggagcattttttttccatatgcccaaggcaggcttacagggtgctgaccccaccccttaaaagtgctaatagtctctcaatgctcaagacaggagggagaattaggaatcaggagcctacccagagcttccctctttcctcactttcaaaattgcactgtgtctagacatagaatttatgcctgggttgggaaatatttatttacttattaatgtattcattcattaatctcactttctgcaatctgtgtaagtgaggggcagaagggaagaggggcacagagggagaggttgaacccaagggcaggtcctggcagtctgggcacaggctctgatcagccagggggaaggaagagggagcagctcctggtgccctggagggaggggatgccctgtccctgctgggcctcccacttcgttgtacccagggaatgcttttcagagaggcagagctcttagcagagtcccgtaaaccatacagtgagttgggcaggtgagtccaggggtaggggctgtgtggagacctgagaccaggtgtggcctggcatggacactgcccagctccattcttttagggaggacaaagtggacagaggaagagacaggagacatgggtgtgtctgagctttgggcagcaggggatgctgtggcctagccctgagggctgtgctgtggatcccagctgggagccaccccctggtcctggcctggagccctctgtcccctgctcactgggactagcagctgtgtcctcacaggtccctgagtacccacagaatagccacacccaggtccacactctcccggggttagctttccaggcagaggtcaagagtcagaacccaaggtggggtttagacagcccaggagaggaggctggtttgcaagtccctcctaacccccttcgccctgaactgctggaaggataggagagacttgaagaatccaggcccacctgagggtcctcaggacacagctgtgtggcgggtccccaccatggcctgggctcgtggcctctttccttttctccttcactgctcagctggctggggccaggcgtcagggctgaggatgaagggaccaggattgctgtgtgtgtccctgtccactaacctgtgtctcttactctttgtctgtcatgatattcagggtcctgggcctgttctgtgctgactcagccaactgcagtgtccaggtctgtgggacagatgaccccagcacctgcactgggagcagcaccaatgatgggagtatgcacgtgttttggtaccagcagtctccaggctgtggtgcctcagaaaccctcctagtcaacaacaccctgcccagcaggagcgggccatgctctgattgcccatctggggtagtgtcagtggggctcagtgagcagctgagctttcaccccaatatcctcaaccaggcgagcatggcagggctagtttgagctggtttatcctcccatccacctatgcctgattttggcagggcccagtcaggaactgaatttcagcccccatccccagcaatgagttgaatgaaatggtacaaggcagagcacaccagccctcagtattccctccctgaacccagactctggtggttatgggggccagggaggaccagagctttgtctcccacctggcaatgagaatactggttggggatggaagtcagtgtcgttggcacacctgctgtccccctccctgccctggtgtcagtgagtcctctttttctcatgaaagtgtcagcagcactggagtactgagagccagcgttctgcctttgctttggcagtgggaagctgaacctacaaacctgtgtccttcaacaactcaacaagaagatcacctgataaaagggagattagtggtgcctagaggctcaaaatacagtatttaaggtgtctagcattcagttcatgaaatcattgtcacatcaagaattaggacattcagaacccaaatgaaagaagacagtgacacgcatggacactgaagcaaactcagatgctaaaatcatatgacggatttttaaagcaacaaccacaaaatcccttcaatgaataattaaaaacactcttgaaacaaatggaaaagaagaaaatctcagaaaagagaagttataaaatcaaaccaactggaaattaaagaacctaataaactagagcacatttaaaaagaaagttaaggcaggactcaagaactggttacatttgagattcagtcactgggtgaggtgttccacacgacataaaaatacagtaaaaataagtaggtaaacacatgaaaatcaatgattctggtttgacttgggaaacattaaagtggaaaatataaagaataaaatagcatttatttattgaaagaaagaactacctttagctttttatcgtttccccattaatactctcttgaagatgttcccaggggacactgtgagtcttctcagaggtgagaaaagcctgaaataaactcccacgaatctcatttaatgggtcctggggcccatgctcactggtctgagttagaggtgatagcaggtgcttcctctcaagtggtgaaattagacctcacagcagcccagcccccctgacagtagagctgctctctcagctgaaaacaacagaagcagatggtgttggtgatggttttggtaaagtgcttattaatgtgtgaaccaaatatatgcccttcatctagggagctgcataggagataaaagaaccatctcagggtccagcagcatcttagagctctgcagatttttggaaagtttacatcatgccctggatgcttctcctccacttccccatcctgttcagtctttgcccaggttcatggagatttcaaagaccagcccatggagagagccctctgttcttccccattcctgtcgtgtctgtttcggtttcagtatccagttcttagggtgtggtgactgaggagccctcactgactctttcctgaggagggacagtcactctcacctgtggctccagcaccagagtggtcaccaacaatttctatccacactggatgcaacagaagtctggccaactttttgagacattgatttatgatgcaagcaacaaacattcctgaatgaccacctgattctcagaccttcctgggagcaaagctgccctgagcctctgggggacccaatccataggctagactgagtactactcaagctacacgacagtgggggttactgcagtgaaagatccagatggggagccaagacgtaaccctgcctctgacagcctggggagaaaatgatcacgtgatatcaggatcacatgaccagaaacctgagctctcaaggcggtctaaatgttgcctatccttaaagaaaaaggtaaacagaagggtctacatcaatatttattcctgtttgtgtccaaaagttgaggaaatccatcaatgaggaggaactgttccagaaaagcggattcctaatattttgtaatccaaaaggaatagtattgcctacatcagatccaaggaataaatttaaatatatttttttgcaggaggaataatcttcaacgatgtactttgccagctaagaacgaaaggaagaaacgttctttggtatattaataacattttttattaggttgtaattaaggtgtattgcacaatttaaaacatattaaaatgattttttgtaagaaattcttttttctatatgttatgtgttgtattggactctaaagaatatatgttaaagccctacaccccagtattcaagcacataaaatcatttgaaaatcggatcattgaagatataatagttaagatgaggtcattctggagtagggaggtctctttatcagtgttcctgggtccttgtaggaagtcaaccatgagaagacagagaggcacagggagaaagtcatgttaatatggaggcatggagtgaagttactcagctacaatacaaggaacaccaaagattactagcaaagaggaagagctgccaggaagaatcccaggaaggttttctctacaggtgtcagagggaacatggccccgccctatggatttggatttctagcttccagaactgtgaaacaataaatgcctttcattttaaatcacatgtgtagggttatttttatggcagctcaaggaaattattacaccaaacagtcattgtaactatttctgagtttgcatgcattctctcatcttgtttctcagttttttcaacaaatgtgaccatgtctgtcttcgtatttcttccttgtataactggcattgaaggttgacgtaagttattctcgctgtcacaaaaattatataaacatgtaaataaggcttaattttattttgttcgtaggtacaaatgcaaaactaattccaattgttttgtaagaaatttttgtaaatatttttctcatgtaaattagaagggtctcttgagttactgaaacacttctggccatttctgtgatcttgtggtgtcaggatgagatggctaccatgttcaatgaaagcttcaaatacattattattttttctaggtttttaaaatttaatacagtctaattaaatagtaacagcagtaactaaatgcactgaaaaacagacaggtgcctgcctatatctggaataaaattacatcaaactagtctccatggtaaaaaaaaaaaaaaaaaaagacaactgctgatatccatggttagacaagtcaaggacaacttggaatttctaaagccatttttctaaaaatcaacagcaacagggacacaactacttcaaggggtaaaatatctatatctacattgttttttattaacgaagattgagttgcacctaaacagcatggcattcttatctttagccttaaaggaaaagtgaaagtattttccatttgcaccagtttgaaatatttctgaaataaggattacttcaaatgaattattacattacttatacacataagagggtctcacatatagtgaaaaggcaaacccaggattttaacgtcaaccttttaaagttgatttgattgcataaaatgagagagaaattctcacacgcataatctgtttaacaaaactcctcggtgaatcaggatgcaaaatataaaatgttctaagggagactctgatgagcaggcatataaaattgaagtgaaacccatgtcagcttcgttcctcccacttctttggtgcttctatgaggagctctttctctactgcaagagcctggacttttgacctaatggagaagaacctcaggaaggcaaggcattctgataaaatgccccttgagaccttttattttttaatttaaagggatcaactggtcttgttcagccttaggaaagaaagcatcactcagataaaagtatttggggaaactttaaatacctggctacctcttgatatatttaaattagattgacttcagctgttcttagaaagcattctgcatagttatccagagcagccactgaagttctggttctccttacatggctgcattcagaggtactccacatgaggcatgtttagaaaaagaaggacccttatacttgggagtttttgttcttccacgtaacctgttagtactgttggtaaaggcagtccccagatggcaccagtgcattttgtcaatggtgagtctagacagtgttgcaggggtgttgctgatgagtagaacagtgagcagataaaggtgagcagtgttgatctaaaggctttggggtccatctgcttatccttgcacacctgaacaaagtcatcagatgtgccacaccatcaaactgttgaagcttggacttgatacatgatagagttccatgccaattgcccatcttcatattcaacttgcagattagttggtccagctgatattttaacagatactgttagtagatcatctgaatgtgaactatctctaaccaagaaatttccttctggtgtctcttttaacttttctttggcttcattaacaatcatccttccccagtgccatcctgtttgagctcctacggggacttcaccagatgcaccacctccagggaaggttcctgtgctgaccctgctcctcactggctctgcatctattccctgccattcccagagggctggagacaccacagggtcatggaagtaaggtcactgaggcaaagacagatggccacccaaactgggtgagaaaggagctttcatttttcctggaagtcagtgggaacccccccaatcaaccctatgggtttctgaaatggtggaagatggggaaggaatgaaaagctgcctgtttttctcaacaggtccaggttgagggatgacaaagttccttgcagatgcatcacccacagatcaccagcaggaggatcctgaggctgcggtcagtgccctggcacaggacacatgggccatgtcccatgcagcaccggtggctccgagtgagagggcttatgctgcaggggaagccaaagattcctgagccacagcggtaagacatgagatgacttaaatatctgtccctcaagtatattattcttaatatttaatgcacaaaatagtgaaagaagagattagcttgcagtgcaaattgaacagattcagtatagcttgaggcatgagaaacaacagctctattaccatttaccaaaaatacaccctgaatggacagggggtgcccgtgagctggagatagggtgccccaattgaggaaatataaatactggttatcagttaaatttgaattcatgtaaacaaccatttaatagatttttatttttagtataattatgtcctatgcaaagttacttatctttaattctaatgtaactggatgtcttgcatcttgtgagataccattcccagcattcccagctgggctctgacatctgagtctatgctatttacctcaaaaacagagttcctgtaacaaagttatccccaagtaagtacttcggttagaaataaatatgtctgggctgggcacagtggctcatgcctgtaatcccagcactttggtaggccaaggcaggcagattacttgaggtcaggagttcaaaaccagcctggccaacatgatgaaaccctgtctctaccaaaaatacaaaaggtagccgggcgtgggggcacctctgcagtcccagctactggagaggctggggtgggagattcacttgaaccgggaggtggagcttgcagtgagccaagattgcaccactgcacttcagcctgggtgacagggcaagtctctgtctcaataaataaataaataaataaatacataaataatttataaataagtgtgtcatcccatccacctcaaggctgtaaaacctagcatgccttatccctcctcactttcttttttttttttttaattatactttaagttctagggtacatatgcacaacatgcaggtttgttacatatgtatacatgtgccatgttggtgtgctgcacccattaactcatcatttatattaggtgtatctcctaatgctatccctcccccctacccccatcccatgacaggccccagtgtgtgatgttccccttcctgtttccaagtgttctcattgttcaattcccacctatgagtgagaatatgcggtgtttggttttttgtccttgcgatagtttgctcagaatgatggtttccagcttcatccatgtccctgcaaaggacatgaactcatccttttttatggctgcatagtattccgtggtatatatgtgccacattttcttaatccagtctatcattgatggacatttgggttggttccaagtctttgctattgtgaatagtgccgcaataaacacaggtgtgcatgtgtctttatagcagcatgatttataatcctttgggtatatatccaataatgggatggctgggtcaaatggtatttctagttctagatccctgaggaatagccacattgtcttccacaatgcttgaactagtctacagtcccaccaacagtgtaaaactgttcccgtttctccacatcctctccagcacctgttgtttcctgactttttaatgattgccattctaactggtgtgagatggtatctcattgtggttttgatttgcatttctctgacagccagtgatgatgagcattttttcacgtgtctgttggctgcacaaatgtcttcttttgagaagtgtctgttcatatccttcacccactttttgatggggttgtttttttcttgtaaatttgtttgagttctttgtagcttctggatattagccctttgtcagatgagtagattgcaaaaattttctcccattctgtaagttaactgttgtacttagttgtactgggtttgatcgtagtttcttttgctgtgcagaagctctttagtttaattagatcccatttgtcaattttggcttttgttgccattgcttttggtgttttagacatgaagtccttgcccatacctatgtcctgaatggtattgcctaggttttcttctagagtttttatggttttaggtctaacatttaagtctttaatccatcttgaattgatttttgtataaggtgtaaggaagggatccagtttcagctttgtacatatggctagccagttttcccagcaccatttattaaatagggaatcctttccccatttcttgtttttgtcaggtttatcaaagatcagatggttgtagatgtgcggtggtatttctgagggctctgttctgttccattggtctatatctctgttttggtattagtactatgctgttttggttactgtagccttgtagtgtagtttgaagtcaggtagcatgatgcctccagctttgttcttttggcttaggattgtcttggcaatgcgggctcttttttggttccatctgaactttaaagtagttttttccaattctgtgaagaaagccattggtagcttgattgggatggcattgaatctataaattaccttggggagtatggccattttcacgatattggttcttcctatccatgagcatggaatgttcttccatttgtttgtgtcctcttttattttgttgagcagtggcttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgcacattgattttgtatcctgagactttgctgaagttgcttatcaccttgagattttaggctgagaggatggggttttttattttattttattttattttattttattattattatactttaagttttagggtacatgtgcacaatgtgcaggttagttacatatgtatacatgtgacatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatattttactgagaatgatgatttccaatttcatccgtgtccctacaaaggacgtgaactcatcattttttatggctgcatagtattccatggtgtatatgtgccacgttttcttaatgcagtctatcattgttggacatttgggttggtttcaagtctttgatattgtgaatagtgccacaataaacataggtgtgcatgtgtctttatagaagcatgatttatagtcctttgggtatatacccagtaatgggatggctgggtcaaatggtatttctagttctagatccctgaggaatcaccacactgacttccacaatggttgaactagtttacagtcgagacgatggggttttctagatatacaatcatgtcatctgcaaagagggacaatttgacttcctcttttcctaattgaatactctttatttctttctcctgcctgattgccctggccagaacttcgaacactttgttgagtaggagtggtgagagagggcatccctgtcttgtgccagttttgaaagggaatgcttccagtttttgcccattcagtatgatattggctgtgggtttgtcataaatagctcttattattttgagatacatcccatcaatacctaatttattgagagtttttagcatgaagggctgttgaattttgtcaaaggccttttctgcgtctattgagataaccatgtggtttttgtttttagttctgtttatatgctggattatgtttattgatttgcgtatgttgaaccagtcttgcatcccagagatgaagcccacttgatcatggtggataagtttttgatgccctcctcactttcaaacagtacaacagttaacatttcctaaccattggagatattaaagcacagatcttttatatgagattagttaaaatttttatctttaatgcacaagagtttgggaacattaggaatttgtacatatgctaaattatatgtaaatgaaatgatacgatgtttggaatatgttttaaaattagttgagtgtgtggagtgaggggtaaagagggatgtaagatgaataagacaattttatgttgatgatgatttagttgggatgctgggtccaggacatgcaatgggcttttctccatagatgtctgcaacttcaaaaacatccacagtgacaaatgtgtaaaaaaaattctgtgaactcttctgtggtggtgtgtgtattgaggtggataagggaccccctattaagggcctgacttctccccctgaagcacggaaataaaggagaatcttgagtttcttcaagggaaatttcaggtacctcactgtccctgagaagaaaacctgactagcaaaaaggttaaaggagcttaaaacaaccaaggaagttagaggcatgggatgtctgggtccctatagaaactaaaaacaacaacttaacatatgcccctgagttgtttttcaaacactcagaccacctccaaaagtctcggctgtcagtaggcctcagataatgggaaactgaggactgaggtctgactgcccttctttgttctaagtctcttactgaggggccctgaggaaatcacgcccatgagccagagctaacatttctttctgttgaccccaattttttggacaaagctttacgaccttaaccagttgcaaatcaggaaatttctaaatctacttacctttgatctgaaagcccctgcttcaaaatactctactgttttaggccaaatcagtgtataacctctatatattgatttacagttttgactatgacttctgttttctgaagatttcccctgcttttaaacacctttgctttcaggccatcagggagtttgggtcttaagcatgagctgcccgattctccttgcttgatgcctgtgataaatgtctcattctcttgctgcaatcctgatgtcagtgcttagatttgtatacctggtcaatggattcaagtttggtccattaatagtgtgtcttgcttttaacagacactcagagttgccagatggtgtgcctccaccctgacctccagttgaagctcatctcctccccgcacacagaggaggacttggtgagaaggccacagaatggaaaggagctcagggtttcccaggaaagagaagtgagtgatactggaggccccagagcaagaggaagggctgtgaggtaggcaggggccataaagtgaagggcatgctggtggggctgcaaggtccagggtttatgtaaacagcaatgaagaaccacaaaaggagtttaagcccaggagtaagatgaacaggctgaatgagaaggatgtctccagctgcctcgaggagaaaggcctgagggcaccaggggatcctggtcatagattattcactaagagaacctgtgagtctagaagtttgaagactatttgcacagttaaagcagatttgcatctgggatacagtgaagaagtgataatttctgcattaatctgtccagtcattcaacgtttctgcagaaacattaaaaggtcacacttatctttcttagtaagccatgaaaaaaatgtaagtagggaaaattaggtttagaatataaacaaattgtattctatctaaaacaaaattctattgagaagtagatgaaacagataagcagaaaaataaaaaggtaggaagacaaaactcacttcataaaataagaaatgtgttacaccatgaactggtaaatgttatgcctacccaactattattttttcacaaataaaatctagtgagtatcaacatgctaaaatcatggtgtgacttaggaaatgttttctgggccaggtgcggtggctcacgcctgtaatcccagcactttgggaggctgagatgcgcggatcacgaggtcaggagatcgagaccatcctggctaacatgatgaaaccccgtctctactaaaaatacaaaaaaaaaaaaaaaaaaattagccaggcgtggtggcaggtgcctgtagtcccagctactcaggaggctgaggcaggagaatggcatgaacctgggaggcggagcttgcagtgagctgagatcgcaccattgcactctagcttgggcgactgagtgagactccgtctcaaaaaaaaaaaaaaaggaaatgttttctgaattgctggatgttaaatctatcactgaggtgattcctgaaacagtccccttctatgtcattgccttgaacaaccccttcatgccactcaagtcagcacaactgtttcagcatctgtggtggtgccatagtgacgtatgcaggtcacttagctttttctagaatgtactcttggggcactggcaccttaaaaggttataaaatttttaaacagttataaacgaacatatttgctcctctcatagatcaagactacttataggagtgagatactggctaggcatctagtagaccacgtcatcatcacaggatataggattcaggacacagatgtgtatacagaggaatagtgtcctggtgagctgcagagatcagctgggctctctggtctctgagccatggggaggtgagtgtcctgctatcagcaggctgcactgtgggacttgcctgtggtgtctgcacagctgctctttaagaaccattcattccaaggagcctaggtctaggggctgggccttgtgctcattgatggggactcggcagctgtcttctctggtctggcagagtctgctgaacagggacctgtgtatggtctcagcaggtgatatctcctagggcccttccaaggagggaaagcaaatcatcttcctcagtctgcagtgtgagctgggctccagccccagggctcaggaagggactgggcagtccctgcatagaaacacatttgcatgagcagcccctcctctgctgggggttgggaagaaaaggaggcctggggcagctcaggctcactgtggtggtcaggggctgtgtccaccatggccagaacttctctcctcctcctgatcctctttcactgctggcctgaacttctcttctccttatgctcctctctcactgcacaggtaaggacaggcctcggagatcaggactcagttttcagcctgcatcagtccctcaggctcaggaacccatgacaaatttcatcctcatcttaaccctgtctcttatttgtgtctgtgtttacaaattccctctcccagcttgtgctgactcagctgtgtcctcccccctacttcctgtatctctgggagcatcttccagactcacctgcaccctgagcagtggctgcagtgttgacatttatctcatatcccgctgtcagcaaaagccagtgagcccttcccagtatctcctgatctacctctcaaaagtcaagtaaaactagggctctggagtctccagctgcttctctaaatccaaagatgccttggccagtgcaggcaatttgctcatctctggggtccagccagaggacaagactatctgttctatctattactgtcagacctgggatattgatacttcagttacacaggcagatgagaaagtgagacgaaactcagcctactaagaatggaactatggctctttttccaattgtcaaataattttcacatacacaaactattttggaagtagctactgattcacaatggttctctcaatgtcccattcaatgtttctgagtcctcaggcaaactaacaacaaaacaatgataaaacatatgacaaaacatatgataacactgactctttccctgctgaaccacatgtaataaaaccagaggagctggtttaataaaacctgaggagctgacttttcttttaaaagaaaagatgacagtcttttggagtctttttcttggtcaaaatttcctagaccatcccagcaggtggacagtcccctacagaagacacgatcctgggaggaatcccaggtacagagctggcctgcttcacttgtgggtacctgccccttcaattgtgaaatcagggaggggagagtaagcatagggggtaggtgaggatcaggaaaggggcaaggccactacatttcattaaccacctttggactccagtgcaagatagaggctgatgatcccatcacacaggtgactacaacctccttgtcatcaacagctcctgcccatggggaagcgaaatgaaaatctatccccatccctctcttcttacatatccctgtcctgcccctgccggtgaccaacaccagctcaggttgaattttgttttgtcacttgtgctattaaagaaaataactccttctcttactggtctcctagttcagacagaatcagtttgtttccagaaatagaaaacgctgctcacacacatgagtgtaaagtaaggatgacaaaaagaaaaaatccaggctatgtggcccagagacccaggtgccctctgattggcctcatagatgtcccctcctcctggcccaggtttgcttgtcattccttaagctctggaaccttgaactacatgggttctgtcttcatagatacagaagaaaaccctccccaagaaggagatggttcccagaaccagcacatgctcacttttctctgtttaattccacacatctgacttatttttgcttccatgagcctttgttgaagatatctctgaatacctctcatttctgttaggtctacagcctatggacctatctccattatatttgtgcttatttttctaacctttatgactgattatcatttaagcttaatatgagatatgcatctatattaaagatatataaatatgtcatcaatggtcaatattattaaagttataagtagtaatgcaaaattgtagctattatatcatttcacttgttcactaacattaatatgtgaagtgagaagatcactttattaatcacgcactcctggtcatgtgtgcggatgagtaagctcaggggggatgctgccatggtccatgggaagcctcaagaacagcagacctggcacatcaggcacaacatgggacacagggagtgagccatgtcagcagaaagcagaatagactgaggcatcagaaacaacccattgccaaactctccactgccttcctgcatgggtcagaccagagctgctcaaacataacgtgcacacagatcatctgggctcctggaaaatgtggactcaggggtctaggatgaggactgagattctacacttctaaagatcccttctcctacaaatccacatatgtgtttctgtatcacaaaattagtaagaatgggggaaaataagaaggaaagccatttgtagacaggaagcaaagaaacatctttcgcggagagaactacagaattttcatgaagaaagacttccagttgaggcaggcagacaaccagagaggacagccgagaagactgaggaggctcctctttcttcacaaaacaaacaaatgaaagcaaaaagacaccaagcctcccccttacctgccctgccctctggctcctgtccaatctccccaccagcttctccttcagcctcttctaaattgtggaccctcctcaccttcccttcaggagatgccctgagtccactgcttctctttcccaaccccactagcaccttccgctacttcctgggtttctcctcagctaccagagaatgcagtgaaccatccaatccaaataaattatcctgttaaacattgaccagtaggtctcctttgtgcggatctgaggaatcaagcagggagaaagaacctgactttgtgagctgcctgagaaatgagttcatggctgaagtgtcccttttctcagctaacatgttttatttcatgcacagggtgtatacagagacaatcttcccctgaggactccataaaagatggggagaattgtgtgtccagttcccattgaggagacacacacagaaaactaaaggctgaggtgaggtaggaggctgccctgaggacgggccttgccctgcccttggtcagggagtgagcagtgttcaagaccctggtggggacaggaggctctgtcaggaccccggcatctggtcagagacacggtggacctggacttgagcagcaggggatgctgtggccctgctgctgagccctctgtggggctgtcagctgggaaaccagaaccctgtgtggtctgtgctcagagatcactgggccaagtagctggatcctctgtgggctcctggggagcctcaggccaggctggatcctctgtgggctcctggggagcctcaggccaggcccaagttaggcccacccctcccagaaatgacacagccattgccgctgcatacagccccagggaggggtacggttgggcagaagagagacaagtttgcatgaagggcccctctctctcttctgggactaccggatggataagagggacctgcatcatgtcagcctcagcagagctctggggtgtttgcaccatggcctggaccccactcttcctcctcctcaccctcctcctccaccactgcagaggtcaggatggcccttagcaccctgatcctgcagctcactcacactgcctcacaaactcataccaggaatgtccttccctcttatccttacttcaggccataatgggcgtctatgtcttcagggtccctctcccagcctgtgctgactcagtcacccactgcatctgcctccctgtgggagcctcggtcaagcttacctccactctgagcagcaaatacagcacctacattattgagtggcatcagcagtagccagggaaggtcccttggtacttgatgtatgttaccagtgatggaagccacaaaaatgggatccccagttacagttctcaggatccagctatggggctgatcggtaggtcaccatctccaacatccagtttgaggatgaagctgattgtatctgtggtgcagatcatagcattggtgtgacatatgggtaaggcaaagtgaccccagtgaatgaggaagcaggacaaaaactgttttctctgctccactatgaaggctgccacgtggccctgagaaacagtgcctgttttccttactactcaagaaagatagatagatagataggcagatagctagctagatagatagctagctagacagataggcagatagctagctagctagctagctagacagatagataggcagatagctagctagatgctagatagacagatacctagatagctagatagattttttgctttgggttccttaggaacaagtttgctaggccaagctcctaaggagtacacaagtctgtattaatgtggccaatattaaggcagatcctgtcaccccctgcatgtcgatacattgtcaccacatgggaactgcaaggacatttttccctgtggatttaaacactggaactctgctgcatggcacacccctgccacatcaagtttcattttaacaatcacccataagatataacttcttaagaaaattttgaattctaacaaaatgctagaaatcacactgttgatacacagcgatggaaataatgaaaatttatagacagtgaaataaaaagatttaaaatttttggtggtttataaaggttttctcagttgttcagtgcgtgggttttgggattaggagaaaatgaggagaaactgcctccaccacattgaacatgacaactgatttgcaataatctaacaaagaagaaggatataaataatcattaatgtcatcctgacagccctgatcctaaatgtcagaattttatttcttaacttttttctccaaaaaaaaaatgtagcttcagaaaaacttctggaatggtggtatgaggccatcagaaaacctgattcaccatacaagcaatgagaacagcagtaaaaatgatataaatctacttttcagaactctgtacattaccaaaagcttacaaaattctgggaatcataaaaaatagtaataacagccagacatggtggctcatgcctataatcccaacacattgggagctgaagcagagcgattgctttatcactcctgggattttgtgatcagactgggcaacagagtgaggcctcttctctaaaaaacattttaaaaaagtagctatatgtggtggtgtgtgggtgtagttgcagctactggggaggctgaaggtggaggatcacttgagtctgggaggtggaggctgcagtgggctgtgattgtgccactctacttcagcctgagtcataaagcaataccctgtctgaatcaatcaatcaatcaattaaaataatgtggaatctctgtaagaatctgaagctttgtggtgattttatttcttttgctctctcccaagttccacagtagccttaaaaaccaacagcctcaaatctcctggatctagggaaactagaaaaatagcattcactgaagcaaccaaataccagatctggaattttctcaaaagccccattcccgtgcgactgtcattatttgagctttccaaagctcagaaaagcttcacgctctgtacttttctaaatgtgaattgtctcagagctcgcttggtttaaacagcttcatcctcaatacatttatcaaaacaatcagtgagatctgttaaggtcctgagtcagtgatacaagatggggtcaataaaaggctgaccaaaaaccttgagagaaaaaaactgggtgtcagaatctgtagaagattttgatgagctctgccatattcctggaaagacagaagatcactctcatgctcagagttatgtgcatggccaggtaaaaattaggaaagtccttaattttcgacactggctgaaatcaacaaggaaggctaaaatagagttgtaaagtggcggggttttgcagtcatgacccaacccctgcacagagcattcggcaaatgctgaggaatgtgttgttcgaggcgtttaagaacatgtctgtccaataataagctaatgactgatataattgagcagagactgcagtggctgcacaagcaaagaaaacagacttagagaattattccagtaccgtgaaacaataaatcatcatcaacaataacaactacaacaaaaccagaagcaattatgacaaatattttaaggaaagaatctgatttccagaatcgtcacattgtgtgactgagaagctccatttggcaaagtgaaattttgaggcagggacacagcaaagtactgtccatacacagggttaaaaaggaaagcaaagcaaaacataaaaacaaacaaacaacattaaaaataagttgacaaaatgatgtccagagatgcatttggtggttactacataaaaacttcaaattagcttttgtaaatgtggtcaaataaataaataaaacaacgttaacaattgttaaggaaagtacggaaagaatgcctcattacagagagaacattggcggggtgcagtgcctcacacctgcaatcacagaactttgtgaggccaaggcagacagatctcttgagcccaggagtttgaggctagcctgggtaacatggccaaaccatgtctctacaggaaatacaaaaaagctagctgggcatggtggtgcatgccagtagtaccagctactcaggaggctgaggtgggaggatttctggagcttgggaggcagaagttgcaagagcaaagatcatgtcaatgcactccatcctgggggacagagcaagagtctgtctctaataataatataataataataacaatagagaatactaataaagaggtatagaagaaaggatcattgaattaaagacagataaattgataattattctgttccaagaatagaaaaaaatgacaaacagtctgcacaacctgagagacgatgtgacaccaatcaaatgttccaatacacacatagtaagtttcagtccttccaccatgtgagctcgcagtgagaagatggcagtctatgaaccagtaagcacatccttaccaaacaccgaagtatctgcttgtactttgattttggaccttccagcttccagaactaaactctgacctattttttttggacatttgcatagtgtgggcctcagaaggaagctggctggaatttgacatcacagccactagtagtctgtgggttgtaaccccacagcataacatggggcttcagctgagcgtagtgacagaggatggagtccacatccaccctctagctgcagacctggtgggcagagacagcacttaggctatgcagcccttcatggtggctttcttcaaagtcattgtggtccatgtgtgcatcaccaggtcagcctctggctggcgttgacagcagagttgtactcactttacccagtcccactacgtggctcaagtctccagtacttcagattacatcagcagcaaattaaaaacagcctgcaggaagcatgagctatatgtgagcttccaagacctggatggcaggactggttcatcgcacccaagggctatgctgctaattactgtgatgtagaatgctccttcccaatcaatggacatgtgaatgcaatcaaccatgtgatcattcagaccttggttcaccttatagatcctgaatatgtcccaaagctgtgctgtgtgccaactaaactcaatgccattttggttctttacttcaatgacaattccaaaatcaccttgaaaaaaatacagaaatatggttgtaagagcttgtggatattgctaacttgaaaccagatgctggggacacacattctgccttggattccttggtcatagctgccttaaaaaacatacagaagcacagtggaggtggagggataagactttgaaaccatctcatgctgatgccttactgcccgagaaaaattttaacggaccttgctaataatttgctcacttggtaagtaacatgagtagttgttggtctgtactaagctgagtttggttgtctggtaactacagaaacttaaacttaaaaggtaccccccaagcccaccaaatttaattttagctatagttcaagctatttgggttattagtgagtaaatagggaaaataatctcaatggagttaaatgtattcttgggtaaagtatcagctggtttattagtgtctatcaaaggtacattttacagatagtgaaagttggggaagtaggaataactcctctattcacagatttcattcccaggaaggcaaattttatactggatccacagtccaggccatagcccgggctccttggggatgcctctgtctcagtctttgctgttatgagtttgtgctggagttctgttggtgtgaaaatatacttatttcagtcaaaacaaaccatatcattttcacatctcagtcctccatttgctgtattctttgctagtacccaaagtagactgattaaactttgaagtgaggcttagaggagtggaaagcatttgtgacaggctccatggtaactgtgtaacatgtgaaagcaatgctgcacctcttctttattggaatgactttttgaccagcacattaacttgaggactgccgactctaatatctatttcaggaaagcggtgctttgtctttttactacagagcataccacgtgattgggttagaaccaacaaaggaaataaaatgggaaagggtgccccacctttaagaatggctttagggggatgagtgtgccatttatgaatggaaattatgattttctcttgtagaaaggaaggctcagattaaattttagaatatttttaaaatatctttttcaccaacatgtactgggaaagcaatttcatactaaactgattaaatgatagttttataatctataactgcagtaatggttttttgtaaatatgaagtataatttattttatatctgttttgctgtaacattgaaggaaataccagacattttctttaagtgtttatttagaaagtaccaggagatggttccaagatggccaaataggaacagctccagtctacagctcccagcgtgagtgacgcagaagatgggtgatttctgcatttccaactgaggtaccgggttcatctcactggggcttgttggacagtgggtgcaggacagtgggtgcagtgcactgagtgtgagccgaagcaggatgaggcatcgcctcacctgggaagtgcaaggggtcagggaattccctttcctagccaagggaagtggtgacagatggcacctggaaaatcgggtcactctcaccctaatactgcgcttttccaatggtcttagcaaacggcacaccaggagtttatatcccgcacctggctcagagggtcccacgcctacggagcctcactcattgctagcacagcagtctgagatcaaactacaaggtggcagtgaggctgggggaggggcgcccaccattgctgaggcttgagtaggtaaacagagtggccaggaagctcgaactgggtggagcccaccacagctcgagaaggcctgcctgcctctgtagactccacctctgggggcagggcatagccaaacaaaaggcagcagaaacctctgcagacttaaatgtccctgtctgacagctttgaggagagtagtgattctcccagcatgtagcttgagatctgagaatggacagactgcctcaagtgggtccctgacccatgagtagcctaactgggaggcaccccccagtaggggcagactgacacctcacatggccagatacccctctgagatgaaacttccagaggaatgatcagacagcaacatttgctgttcagcaatattcgctgttctgcagcctccgctgctgatgcccaggcaaacagggtctggagtggacctctggcaaactccaacagacctgcagctgaaggtcctgactgttagaaggaaaactaacaaacagaaaggacatccacaccaaaaacccatctgtatgtcaccatcttcaaagaccaaaggtagataaaaccacaaagatggggaaaaaacagggcagaaaaactgaaaattctaaaaatcagagtgcctctcctcctccaaaggaatgcagctcctcaccagcaatggaactaagctggacagaggatgactttgaggagttgagagaagaaggcttcagacaatcaaacttctccgagctaaaggaggaagtttgaacccatcacaaagaagttaaaaaatcttgaaaaaatattagacaaatggctaactagaataaccaatgtagagaagtccttaaaggatctgaaggagctgaaaaccatggcacgagaactacgtgacgaatgcacaagcttctgtagccgatttgatcagctggagaaagggtatcagtgattgaagatcaaatgaatgaaatgaagagagaagagaagtttagagaaaaaagaataaaaagaaatgaacaaagcctccaagaagtatgggactatgtgaaaagagcaaatctacatctgattggtgtacctgaaagtgatggggagaatggaaccaagttggaaaacactctgcatgatattatccaggagaacttccccaacctagcaaggcaggccaacattcaaattcaggaaatacagagaatgccacaaagatactcctcgagaagagcaactccaagacacataattttcaaattcaccagagttgaaatgaaggaaaaaatgttaagggcagccagagagcaaggtcaggttacccacaaaggggagcccatcagactaacagctgatctctcggcagaaactctgcaagccagaagagagtgggggccaaaattcaatattcttaaagaaaagaattttcaacccagaatttcatatccagccaaactaagcttcataagtgaaggagaaataaaatcctttacagacaaacaaatgctgagagattttgtaaccaccaggcctgccctagaagagctcctgaaggaagcactaaacatggaaaggaacaaccggtaccagccactgcaaaaacatgccaaattgtaaagaccatcgaggctaggaagaaactacatcaactaacgagcaaaataacaagctaacatcatgacaggatcaaattcacacataagaatattaaccttaaatgtaaatgggctaaattctccaattaaaagacacagactggcaaattggataaagagtcaagacccatcagtgtgctatattcaggaaacccatctcacgtgcagagacatacataggctcaaaataaagggatggaggaagatctaccaagcaaatggaaagcaaaaaaaggcaggggttgcaatcctagtctttgataaaacagtctttaaaccaacaaagatcaaaagagacaaggctgttacataatggtaaagggagcaattcaacaagaagagctaactatcctaaatatatatgcacccaatacagaagcacccagattcataaagcaagtcatgagtgacctacaaagagacttagactcccacacaataataatggaaggctttaacaccccactgtcgacattagacagatcaacaagacagaaagttaacaaggatatccaggaattgaactcagctctgcaccaagcagacctaatagacatctacagaactctccaacctaaatcaacagaatatacattatcagcaccacatcacacttattctcaaattgaccacatagttggaagtagagcactcctcagcaaatgtaaaagaacagaaattataacaaactatctctcagaccacagtgcaatcaaactagaactcaggattaagaaactcactcaaaactgctcaactacatggaaactgaacaacctgctcctgaatgactactgggtacataaagaaatgaaggtagaaataaagatgttctttgaaaccaatgagaacaaagacacaacataccaaaatctctgggacacatttaaagcagtgtgtagagggaaatttatagcgctaaatgcccacaagagaaagcaggaaagatctaaaattaatacccttacatcacaattaaaagaactagagaagcaagagcaaacacattcaaaagctagcagaaggcaagaaatgactaagatcagagcagaactgaaggagatagagacataaaaaacccttcgaaaaatcaatgaatccatgagccagttttttgaaatgatcaacaaaattgatagactgctagcaagactaataaagaagacaagagagaagaatcaaatagacacaataaaaaatgataaaggggagatcaccactgatcccacagaaatacagactaccgtcagagaatactataaacacctctatgcaaataaactagaaaatctggaagaaatggataaattcctcgacacatacaccctcccaagactaaaccaggaagaagttgaatctctgaatagaccaataacaggatctgaaattgagacaacaattaatagcttaccaaccaaaaaaagtccaggaccagatggattcacagccgaattctaccagaggtagaaggaggagctggtaccattccttctgaaactattccaatcaatagaaaaagagggaatcctctctaactcattttatgaggccagcatcatccttataccaaagcctggcagagacacaacataaaaagagaattttagaccaatatccctgatgaacatctatgcaaaaatcctcaataaaatactagcaaactgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatacagaaaaggcctttgacaaaattcaacagtccttcatgctaaaaactctcaataaattaggtattgatgagacgtatctcaaaataataagagctatttatgacaaacccacagccaaagtatcatactgaataggcaaaaactggaagcattccctttgaaaactggcacaagacagggatgccctctctcaccactcctgttcaacatagtgttggaagttctggccagggcaatcaggcaggagaaagaaataaagagtattcaattaggaaaagaagaagtcaaattgtccctgtttgcagatgacatgattgtatatttagaaaaccccattatctcagcccaaaatctccttaaggtgataaacaacttcagcaaagtctcaggatacaaaatcaacgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacaaaataaaagaggatacaaacaaatgggagaacattccatgctcatggataggaagaatcaataccgtgaaaatggccatactccccaaggcaatttatagattcaatgccatcccaatcaagctaccaatgactttcttcacagaattggaaaaaactgctttaaagttcatatggaaccaaaaaagagcctgcattgccaagtcaatcctaagccaaaagaacaaagctagaggcatcatgctacctgacttcaaattatactacaaggctatagtaaccaaaacagcatggtactggtaccaaaacagagatataaaccagtggaacagaacagagccctcagaaataataccatgcatctacaactatctgatctttgacaaacctgacaaaaacaagaaatggggaaaggattccatatttaacaaatggtgctgggaaaactggctagccacatgtagaaagctgaaactggatcccttctttacaccttatacaaaaattaattcaagatgggttaaagacttaaacgttagacctaaaaccataaaaactctagaagaaaacctaggcaataccgttcaggacataggcatgggcaaggacttcatgtctaaaacaccaaaagcaatggcaaccaaagccaaaattgacaaatgggatctaattaaactaaagagcttctgcacagcaaaagaaactaccatcagagagaacaggcaacctacagaatgggagaaaatgtttgcaatctactcatctgacaaagggctaatatccagaatctacaaagaactcaaacaaatttacaagaaaaaaacaaccccatcaacaagtgggcgaaggatatgaacagacacttctcaaaagaagacatttgtgcagccaacagacacgtgaaaaaatgctcatcatcactggccgtcagagaaatgcaaatcaaaaccacaatgagataccatcccacaccagttagaatggcgatcattaaaaagtcaggaaacaacaggtgctggagaggatgtggagaaataggaacactgttacactgttggtgggactgtaaactagttcaagcattgtggaagacagtgtggcaattcctcagggatctagaactagaaataccatttgacccagccatcccattactgggtatacacccaaaggattataaatcatgcttctataaagacacatgcacacttatgtttattgcggcactattcacaatagcaaagacttggaaccaacccaaatgtccatcaatgatagactggattaagaaaatgtggcacatatataccacggaatactatgcagccataaaaaaggatgagttcatgtcctttgcagggacatggatgaagctggaaaccatcattctgagcaaactatcgcaaggacagaaaaccaaacaccacatgttatcactcataggtgggaattgaacaatgagaacacttggacacagggtggggaacatcacacactagggcctgtcgtggggtgggggtaggggggagggatagcattaggagatatatctaatgtaaatgacgagttaatgggtgcagcacaccaacatggcacatgtatacgtatgtaacaaacctgcacattgtgcacatgtaccccggaacttaaagtataataataataataaaaagagtcagccccctagcctggcagtgctgctctacaggcaccctcagccctgatcccttcactgcacctaggggacacagtttacaggactgagtcagtgggacaccctgttcctttacattcccagtcatgggctcagattctgcacttgtctcactgctggagggaggagcctgcatcagtcaccctcaaagaagacatgaagttatttcacctgtaaaggcaagaaactgttcgcagcactgggggcaggcttggggaagatgaggtttgtgaggatgttgagaattcatgcagctcatccttcagccctatagctttccagagaagtgtataatgggggtcactaggcatgtgagtaactgatttggtgaaagatgccacttcagatcaaaagtgcatttccccttccccaaggtgtcagcaacactgaaacatatttgactaactttatagaggaagattaagatagaggatgagagagacataaggcctcaggaatatcttagccaatagaaagcctgctggaagatgcatttccaatatgattagactgattgaaaaccttgaaactaaacacttccaaaggagactgggacccatttctcctgagaatgacaacacaaaaaatagtagaggaaaccaacaaaccaaaagcagacactgtttcagatctattgaaaatcctcaagatagtctcataatataatattcaaaatatctaggatacaattcaaagaaacacttgttatatcaagaagtagaaaaattcaccatttgaatgagaaaaggcaatccagacatcaacgctgagatgatttagggctgaaattacctgacagatatattgaaatcagccaccataaaatcctgttgatgagcaatttcaggcattcttgaaacaaatgaaaaaggataaattctcagaaaaaatagaagtcataaaatcaaactaaatataaatacaaataaaataaatgaaaaatttaaaaatacctctctggagagactcaagaacaagtaactatgaaactaaaatccacgcattagagaagacacttaacactgttaactagagaagcacaaaccatagttatcacagcccagcagggcgagcaatcagtctgctcagaagtgagaggcctgaaaaaaaactcctggtgtccctgatggtgaaatctggcccctgatcccagggttcctccctcttcgtgctcagagggctagacctagcagtgaagggttcccaacctcaccctatgcggcccctccagaaggcagagcccattcttgctgatattcccgatctccaataacacaaagtgaaagagaatgtcttaaccagagtactgagtcttggcctatctgaacatatttcaaagtttaaatgtacagtgagcataggatgctgagcagaggccccctggacagtggctggagttgggagcagtgcaggatggaaggacaggtcaggggccctgagcacctgtacctgcacctgcacctgcccagggtggacatgactcccgcatccaccagagggcgttgtggtctaagcaactaatcagagctccccagatcctctgctgttttccctccacctgctggtgtttctgtgccctccagatggtgttgctcctcccccttctatgaccacttttcagccataaccttgtctgaggtcaaaggagggggttgtgcaaccttcagaaagggagaaatttgcatggagccctaccactctgaggatacgcgtgacagataagaagggctggtgggatcagtcctggtggtagctcaggaagcagagcctggagcatctccactatggcctgggctccactacttctcaccctcctcgctcactgcacaggtggctgcctgcaaggaattcagggagcgttcctggatgtcacctgggctgatgatctgttcctcctgcctgggaaccagtcttcatctctcccgactgatctctgtgttgctctcttcttgcaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtagctctcccatctctcctgtctaagtgcttgaggtgaactttgcttatgacttcctcttttccttttcaaaataccaatctgtttttccacaccttgatggctgattttctgatatgtgcacgatcaattgtgggataaatgtagtttataatcgggtctctgagccacaccatgattgatgttctggttggggctgccttgcacagtataagttattgacttgcatctctggcctctacccttagatactattaacaccctcccctcatttgtgacaacaagactgtcttgagacactgccacatgtcccatgcttggggacaaaatcagcccaggttgagatactcagttaaagagcatgtcttcagctactaagaagcttggctttgaaatgtgtttatgccattctgctgagcatgaggctggttttctaatttttgtttctggttcccatctatgagacaaaacaataacaccaaacttcaatgttttgatggttgaatggtttttccaagcaacaagaagtcagagattgtgctacttagaggtgtagaagccctaaccagatcctgtaacacagagtttagctctgactaggacagcacacaatgccttccatcaatctccaacccacagcccgcaggctgcatgcagcccagaaaggctttgaatgtggcccaacacaaatttgtaaactttcataaaacattatgatttttctgcaattttctatagctcaccagctattgatactaacagttagtatcagttttatgtgtgttccgagacaattcttcttccattgtggcccagggaaatcaaaagatgggacacccctgctttgcacttttgtacaatgcacatggaaatataatagagccttcttccttctaaggtcatgtgactcagccattgaaaggtggaagtgctgaaatgagctccatatgaacggaccttgaaaaattatgctcagtgaaaggaacaaatgcaaatatctagaaatgaaatgtctggaaatgactgtatttataacaaatgtccatgatacgtaaattcatggaggctgaaaagatcgagattatcctcaaaccttgtgataatttaggtgaaaaggatgatttcagaattggatagaaagtgatctacttcaaaaataagctggaaatgcctccacgaacagaggcgatgctttgcggaatcctaggtggagaagtgtatcaggtgcagatgaggtctttaagaatacttcttgttttgttttgtaaaattaaatatgaataagaacactgtgggccaggcgcggtggctcacgcctgtaatcccagcactttgggaggctgaggccggtggatcacgagatcaggagatcgagaccatcctggctaacacagtgaaaccctgtctctactaaaaatacaaaaaaattatccaggcgtggtggcaggcacctgtagtcccagctactcgggaggctgaggcaggagaatggcgtgaaccagggaggcggagcttgcagtgagctgagtttgcgccactgcactccagagcctggctgacagagcgagactccatctcaaaaaacaaaacaaaacaaaaaaacactgtgcttgctcgcttacctcctcctcaggtcatttcctgcagtctctaagaacagtccgcctggcttccccatctcctccctgagcgccagcatctggggcgtgaacagcacaatcaaggccacacctgtgagaccctcagtgcgtcagcagagctgtgtcctggtgatgtcaagggacacggggtcagcaggggacctgtgaggctgtctcagggggtgagcatgtctggccctgccagctgggaaggccctcaggaggttgaggggagctgagcacacagtgagctcactgagctgagatgggaagtgactgcagctgtcaggaccttcagggacactcagtctaggatcaggctctctcaccctgtggggcctggttcaggtcaactcctcatcctcctcttcttcctccagacaagagagacattgcctatggctgaggggtcctggaggtgatccgggtgcagggacttatttgaatgtaggaaattctctcccagtgagacctgtagagactaaaagagcgttaggaacattcactgttacggctggagtcttagggtgcagatctcttgagcacctgcaccatggcttggcccctctgctttttgacctcttccctccctgcccagctgaggcacatcctgctctggggagaagggtctatgcggtcctcagcccacctctgctccactccctttctcacagggctcattgttttctctttctctccaccctcctgggtctgtggtccacatggcactgacagcctctttcactgaccaagcctccgggactgacaattacaatcacccaccctggaaacagccataatactgtcaatcaaggcacagcttggattcaggagcacctgggacatgtccccaaacctcagacccagagggggtaacaaccatccctcagggacctcagggaatttcccagccccatgttaggcagtttggcctccctggccatctctgggctccaggctggcgacggtgctgattttcactatttagcacagaatggcagcctcgctgattattctctgattatctggatgctctgtgactccttctgtgcatctctgggatcatcattcagactcacctgcaccctgagcagtaacatcaatgttgtttgctatgacatttactggaaacatgacagggcagggagccttccctccctggtatctactgagattctactgagattcaagcagaaccagggctcagggtccccagcctcttctccgtgtgagtgggtgccgtcgccagtgctgaggctttccatatctttggtctcaagcttgaggatgaggctactcatggcacagtagtgcctctcacagtgccatggatgggatgttctctctaaaatagaagtctttttttttttttagtttggcccctttgataagtagattctataataattaaagaaaaaaagtaatgtcttttttggagagtagaaacactggtgaaagagaaaccgggaaggacttggcatggggggtgggtgggcttcaggccacggctctgacccccacgaaaggagagaaggaagggggattagtaggaactgccccagcccacaggcaggtcagacctcagacaaagcctcagccaactgagtgggttctttcccacgggtgcccattacaagtgccctgcttcctgcaggaagacctgcctggagggaccctggggtccccattgcctggagccagcccacgggcaggggacatgttagtcacttgtggtcctcctgcacgttctcccaaagaggcatctgagtgggacacttccacagccgccaccagcactgctgctgcattccccctcaggacaggggcagtgccttccttccccggctcatctacctgagccccatgtgaagtcaaagcttaggtgtctcagggctttcctccaacaggccctgcagccactgagacccttatataccctgagctgcatgctgtggagagagggtctgtggaagaccttggctcttagccatcgactcctctggggaacaccatgaaatcctcagactggggatgtcctctggagccatctttatcctcttcttcttcccagtatctcctgctccatgatctgggtcctgtccctggccctgttgcatctccagtgtctgatccatgccagcccttccttaaatatgtgttgaacccatttcccatttgcccaagaaatgagtgctggcaatgagctgcactttttttttttctaaatgggaaatgggtcaataaatgaatgaatgaatgaataacaacgcaacctgagtctcctgtcacatggttattttaagacctgcgtttttctttacccaggaggaaaatgagtacctgcagccgttattgcctctgaattgagctaacttgtttctacactgtcatgccatggtcacagtgggacagatgtacaccaagcctaccatagctttcagccctgcccttccacccgccccacctgtggcagtgatggcatcaaggcttccctcagagtcggcctctacccaccacacactctgggccatctcctgctctccaacagcctggggttcagtgatccctgtccatgtgttctacctcagagacacctgccactcctccccttccctaatttctctgccatcctgtttctccagcctcccaggaatgtcccctgcccaatctcatgtctcaggttctagaacttgtcctggaacttccccagagctgagtctctaataggagagctgatgacaggcacagccgtggtcaagccctctagccagcagatggaggagaatcagcctgagggccctgtgcatcctccctgctgcacacctgggcccatagccccctccaccctccatatgctcctgcagcccccacctcagtgtctgcctcagtgtctcctcccagcaccttcctcaggaagggcctgagatcttgcatggtgtgtttccccttggtgaactcctagtcacagcagcatcccgagtaagagcctcctggtgaagagatcgtcttggtgctccaccctggcattgtgtcctcagctccagggcaggtcacacgctttcctggaccaagattacatgcaggccacccctgctggcccctgccccacagagggaggcccggggtcaggggtggcaccaagaccacagctccattgatccctgtaggaattcttcctgcatgtttgaaagacaagagttacagaaacaaagcagagggaagattctgggtcattgcaaaaggagaaatttgcctgcagaccagcaggggacgcggtgagaccttctctgtgtatttctgcaggacaggtgctcacagctggggagccctcaactgacagaggcccagggctgctccttcatttcctcctgggactctgcagccttgtcccatctgtgcctggcagagtcctctacacatgaccctgtgtgtggtcccagcagctgctgctttctctggtcccacccgtggggcaaactcttgcttcatgccagcctccctgtccaagggcctggtccctgcgagtgcacctgggggagaggcaatggggaaacacatttgcatggtcagcccctcctctgtgagcccagtgacgctgggataagagaggcctggggcagcccacccctaggtctgtggcctcagaggcagctgtgtccactatggccctgactcctctcctcctcctgctcctctctcactgcacaggtagggacagggctcagagcccagggtggtccccagcctgatctgtccctcatggctcagatccctcagcagctgcgccctgaccctgctcctcactgtgctgtgtctgtgtctgcaggttccctctcccggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaatcacagtgagacagatgaggaagtcggacaaaaaccaaggttttaagcttgtcatttttactgaactggttaagaacttcagtggttaataaaatcacattaaatacaggattgttgttaaaaatggtggcacattataactctctcccatttttttcacataatgcccatagtgactctaagcagctaaaatcaaaacacaaaaacttataccaatactaagaaatactaacattactaaccaatttccactagtaaaagagttgtgaaacagctgaaatacatccagatggcataatacataataccactatatacaagagttgtataaaattatgtatcatgtatatataaaattatgtatcatgtatatgtataatatatgaaataaaatgtcagcagacattaccgtcttcccaccagtagccagcaattctgccctgcctctagaataaatggttaccacgggttgaataggcgaacagccctggcagctctgcaggatgactctcactgtttgttattgttttatttttaagattgcttttctttcctattttttttgaggcagagtcttgctgtcagccaggctggagtgcagtggagtgagctcggctcactgcaacctaagcctccctggttcaaacgattctcctgcctcagcctcctgagtagctgggattacaggcgtgcgccaccatgcctggctaaagtttttgtattttttagtagagacagggtttcaccatgttggtcaggctggtctggaactcctgacttcgggatccgccgtcctcggcctcccaaagtgctgggattacaggcgtgaaccaccgtgcccgacctcttttttttttttttttagtttggttttgttagtttagttttgttttatctctttaacttgacagtcagagatgatccatgtggatctctgcatgggtctgggagctgcaaggctcctggtgcatggcccggtcccgcctgccttggcagggctcctccacctggctcctggaggagcagctgcgcccgactaccctgcatggagcccgcggcttagcggcagctcgggaggggcctgatagaaacttccccctgagcaagcagcgccaaacccaggccgccacccaggatggaggctgcatcacccccggggagcccggatcctcgccagggtccaccaggagaagagcacatggcggagatgagcctgcggggctgggagagagagaagacacggcgaagctgcaggtgaagacgctgcactaaggccccacccagaggctgaggttccccgaccagaccagcagcagcgaggctgcccagagcggcgccagcaaggtggttctctccaggtcggatcacaggagaagctagccttgcacctggcccaggcaagaagcaggacatgggcttacgcagaagaatcagcaccgattccacatcattccccatggcaacggcctctacggtgctgtcagcaagacccagtgctagacccgagcctgcaccaggagctgcggagcggagggtgcgccccatcccgatcgtctccaccactttagctccctgggtgagggtgacacggggaagcttattatcgcggctgcccaaaacggggcgtggctgggtaccctgtgtacatagggtagatgctgaatgtgaatagcactgaactactagagggaggctggagaggcccacagtgtctatctaccatgattcattatttgggcccagaggattgcctaaggcctagtatttggctcagttggctcagtaacgggcactaggatgcagtatttgatcactcctatcctaaccaagtacgacaactggtgcaaacagactcaaaagcaaaggcaacgcaatgaataacttgctcactctggggccacatatgctgaataaaatgcctacccttgaaatgtctgaaaaccttacaccctgggaaaattgcatacagaacttgtgcttggagaatgacatgaactctaatcagggtaataacacttgtaaagttcctaacagcttttctttccttttttttttttgtttttgagatggagtttcgcagtgttgcccaggctggagtgcagtggcgcgacctcggctcactgcaagctccgcctcctgggttcacgccattcccctgcctcagcctcccgagtagctgggaccacgggcgcccaccaccacgcccggctaattttttgtatttttagtagagacggggtttcacggtgttagccaggatggtctcaatctcctgacctcgtgatccacccgcctcggcctcctacagcgctgggattacaggcgtgagccaccgcagctggcacttcctaatagcttttctgtgagtgtaacgccataatcatcttttaaaatgttttctcggaactaaaagttgctgggcgcctaaatgatgttgcatgatagttttgggtgattttactgcatctgtaattttctgtttaagtgagcaccgcttaatttgaaagctaatttctcacagtgtaaatctgttcattcctggtagtctattttctacaaaagtgtatttttacacaacattaaaaaatggtgtaccttcatctatgacagtacattacttttgacaagcagctttcaggcagaaattaagagaagtgttttatataaaatttattattttgaacagagtttgtgatttggtagttacgctgttgaaatttgaattttacaattcttagaaacttatattgatgcattcttgttaccaaatgattggcccattacattttgatacaaatagatttgttgttttggaaccattatttgtttagaaatggtcaatcttttagagagaaatacttaacaaaggattgtgggaagttttttttttcttcttctttaacggattgtaccaggtcttacttgaatgaaagtctgatgcttgctgatggcagagtgactaatctgcactagattgatgtttagagcagaatgttgggtgatctcaattgtttttatttatgtttgtgattttgttttaaggtaatcttaacatggtataagactctgtgacaagctaaacctactgcaatatagcatgttggagtcccctaagagttttaaaagctaatggcataaatgcctggagccaacctcggcagttatttcatagcagaagataccgtcttaatattccttttaaattcttttaaaaggcaaaataggatcatcctattttataatgtacaaatgtctgcagagattgtatggtttgttgtgttaatgtttcccacctaaaatctatcatattgccactttgcctaattgtagtcacatttattaagtaatgcagtttgtactttttattttgtaacattctgtgatttttgtacaacattgtatttgtacaatacagcaattcccagttgattgaatgaataaataaaatgtaaaatcatactttataaaaagatctatgtggctgatagaattctgacattcccctccaaatggaaagtgatgtgtttctttaaagtaaaggtagaggagtcttaaatataggtgttcctgcccctattgagaggttttcaaaacatgctcttaatttaacgtttaaatataccagagtcttagaatgtgagaataatgaaattggtttgttttaattttgtgataatattaaatctactggaaagaatattctcctttgaaaagattctcagctcagtgatcatagaacctgtacttgcgtttaattcaatgaggaaagacatagaaatgccacgttaatatcctcatttaggtggtttctcccttcactgatcagcctatgaatgtgtcaatgcagtactccccagtttaggcttaggtacttattgaaaggatgctgcctgagcatttttaataattgctatttcaagatcacattttggccatgaggcaggctgccactcactttaggctctgcctaggcaggaatgggtcctggaagacacatgttctctctctctctctctctctttcacacacacacacacacacacacacacacacacacacacacacacccctctcttctctctgggtacacattattctggacatcttcagtttccaggattctctatgtctccagctagaagtcagggcttagcctgtggtgatccagccaccctcaggttgaatctcgatgaagtcacaggaaccaccagtggcatggagggtaagggatcctgctatcaggttcagccaggaaatgctctggacacctgctggtggaagagtttaatgctgggcaatcacaagtcaggtcccttcttccagtcggcagttcagcctccctgactttctctgggttccagtcagtgcatgaggatgatggtgacatttattcaggggcagcacagcagcctcagtcaccaccaacagtcactgtcatatgagaaaattagatagaaattggccttccaactcttctgtcagatccatctttgccctttttctgcctgcttgagtgaatacgaccaagaccagctcaggtttttgctgatgctatcacacgtgctcctaaaaccagaaggcttaatggtattttctgtttatctttacggattcaatgaaaagacaccttttcttactggtctcccaatgaaaacataatcactatgtccacagtaacaaagatagccctcgttgttgtctgctgggatgagaagagcagcagaagtttggcaggtatggccctcatgggcttcacatgtccctacatctggccctggctttgctgatcaccctttgggctctgaacccacagggaagttaggtttctctttcttttgagattgcctctggaagagctgctctgttcccaggtgcagggcagcccctccgcagtaaggacccagctctcagagccatgaaggcctcaagcctccaggttgactccacatttctagtgcttgtctctggttctttggttggaaagatgttggatgaatagaagttctctgagacctaggctttgtgaatccaacccccattaaatccagggatctttttaacgaataaaatgaatcagggcccagtgatggtggggaaatgggacgtgagggttcctcaggccagtagtatggggagaacatccaaaaagaaaggaggggttccacttttgagaattgtctttttatatccatccacatattgacgaaaattataaaattagactaaaataccttaaatatataacatggtcaaaagaaaagaggtattaccaggataatattaaatagtaaaagaagtcagaggcgaaacagagcaagagacactttttttctgacagcatcattcttatgggctataatgccaaggcttgtgcagtaggagctgaaggaatctcacaggcgaccctcacgacaataatgacaataacaaaataagtcaacctctaaaagaagcccatgtagaattatccccaggtatgaaccacctggaggctcagcagaacattaagccttagattgggttcaagatgaccacagactggtgatgaccacaggcccctgggagcaacacactcacacgcctggtgatgctgatatctggtaaatcatcactgtgcatcctgaaacacattctgtgattagctctttgcagaccataactaacatgaaagaaataatgcctcagctgtaaacactgcagagaggacccactcattctactcccttaggtcatgagttgaaagatccatttgcaatggtcaggatgtccttccagaagagctgggtctgttctgaggggccacccgacttgggatcggagcccagcagggggtgctgttggactgttcctgagagggcagggctctgggccaggccacataggaaaatactggttctcatacacttgagcaagcagtgtcctcactgaagtatgacttcctgcacctgcaccaccgagcaggagccacttcctgcacctcaggagccactgagcactagactcacacgccaatgcttcctattttatcctccgccctcatggagtccttgtccaagcctgcccttcaagcagagacaaatcacacagcaggaacaaatttgctcaaaggaacttgaactacaatgtttcctgggcacagaatgagaaacacttggaattggggaagttcccatcctaacaacttagactcaggaagaagaaccctggagcttctccagcatggccagaatctcagtccacttcaaaatcctcagtctttagatcaggagttcttttagggatgaggtcaaggtttctgggtgcacattaccactgcctttcagtcctatcatctgggcatgaggagcttgttatctcgttctatccattatttctaaacctccttgtagagggctgggttagagagtgctaactgccatttatacagtctggacctttgtataaaattataaacacacacacatacacacacacacacaaacacaaacacacatacttattttgatgttccagcgaaagagtaaaactaaactcaacagaaacagaaacagatttgaataatacaagacaatctcattaatgaacatagaagcaaaactctctcagaatattagcaattagagtccattttatatcaatgaaggattatcttgagcatctgggaggatgtgggttgagacatttgcacagtcattggaagacagtgaacatgatttttgaaaaaacagcatgtttagagatatcaaccagaggtcagatgcttcaatcagagaaagatcctctgagttctcagggctgcttccctgaaaagctacgggagaaggaaatggagtgactggacacaatgccaggggattcattgaccctttggcttcccatgggcagcatgcatcagcatggtcttacaaggatgaaaaagggcatccctcaaaaaagaccgaccatttccccagaaattaataaagaaatatcatggccgggcgtggtggctcacgcctgtaataccagcactttgggaggtgggcggatcaggaggtcaggagatcgagaccatcttggctaacacagtgaaatcccatctctactaaaaatacaaaaaattagctgggtgcggtggcaggcgcctgcaatcccagctactcaggaggctgaggcaggagaatggtgtgaacccaggaggcggagcttgcagtgagcctagatagcaccattgcagtccggcctgggcgaaagagcgagactgtctcaaaaaaaaaaaaaaaaaaaaaaaaatcacagtattttcaccagtgcatttctgtttgagcgaatatgttgggtgaagaaatatataatatatacttttctaaatgaaatttttatctcacaaaattgtagaattaaatttttgttttggataagaaatcaagaaacaatcacacacattcttatgatctcatgaaaaccaggtataggaaaggaagtgacgaccccaaaattcatctaaaaagtgaaggttttggttcaaagataagagggttgtcatgttcaagacaaagtcactaccattcgtggtatttaaagctgttggtacaagtgcctatcattgccgattcccttcaaatttcttgtgtatgtttggatcttaaacatgagcacacacaaaaagagaaacagcaaaactagaaaacagatttacctttttgagtttccaactggaggagaaaatgaacaaagagtaagaatatcacatgataatgggaggaggagtgttaggaaggtgatgaggagcagttcagccttcccagcttggggacagtcttagtggagcagagaaacctccttcctgctgccacctgactctctagagtagatgaagaataaataactaaacataaaaagcccttaggaaaaagattgtcatgatgtcagtgctattaatagttcagttaataattctgtaagaatatgcaaaaacttactggctttttaaaaatttttatttatttatttcttttgagacggagtctcgccctgtcgcccaggttggagtgcagtggcgcgatctcggctcactgcaagttccgcctccagggttcaggccaacttactggcttttatatttggaatcacaacctgaaaggctgcagaacatgaaaggaagaaaactcagattgcagtgttcattctcttttatattatgagtttcctgcaagagctacatctgttattatgcaaaaacaaacagataaggaaacaagaattatccagcctcaagagtggaataaaacatgcactttttttgcttgtaggcataggtgagtaattcagacacggctgctgtgggtgactcatttccccttatgatggagcctcagcaaaaaagcttcacagattggggctgatttggtatgaaggggttggaatcgactgaaggtgacctcattgagagtctgcagtgaagccggccttggctgaatgacctacctgaggcctcccatgtggcctgggtttccaggaagctgggcagtcccagagaattcagagctctgacttggtttataaagtgtcacttccacagaaactgtcagtgccgagagatcactagtgccagatctggttaacagggaggggcctgatctcacccctcaacggaaggtgacgggaaaacaaaggaaaagctgtcttcacatcaacatgggcagataccactttaaagcatattctgtagcagggttcccactccagaagctgtggtacaggatgtgtctcctatggcatgggccaagggagggtaaaggtgagtttgacatctgtctcagtcaccatgaggtttttctgacaactaaatataaatatgtaaggtgtctcacagcacaatcatgtgacaataaatgcagtgcgtgccttcaatattgctctatcaaggaggctttccctccactccaggtgtgagcacgtggcttgcatgtccctccactccaggtgtgagcacgtggcttgcatgtccctccactccaggtgtgagcacgtggcttgcatgcccctccagcttcctgcactgtggtcatactgctgctgcctcattctcagcctgagcatccctacacaggcacaaactctatggctcaggctggtcatcactctgggtccacagtagctggtcagagagaaactgtcttcagccctgcccagcaggagaaaagagcattccagactgatcagctgggttcctgccatccagaagtccttgtctgtctggaggctcaaaacatgactgtgattcctttgaggactcctcccatacccaggctgtgggcttcgctgccctcctcaggacccgtgcagcctgttctatccctgcctcagctgcaggcaaagctgcttgccacaagctccctgctcataggatgccggagtcctcccaagggctgctcttcctggagaagaaggagaaccaggcagtaaggtctacctgagcatcatgggaaggaagtgatccgattctgactccggtgggcgcacacccttggtgctttgtgtctcctgctatcccagccacaggagtgggggaaatgtgtgagttgtagtcctagccgggaataatccataaaaggtgaaggtgagagaaggacactatgcatggtgtcaccttgttttcctcgttgtttcagcggcctgagtcctgtgtttcctgaaagatctgtggctcgaggtgacacgccctatcaggggacaggaatcaaagaggagaatctctgatggaaaaattcacaaaggaagagggagataaaaattgggcaacatgctcagggtgagaacgatggctttttgtccttgtgatagtttgctgagaatgatggttttcagcttcatccatgtccctacaaaggacatgaactcataattttttatgggcaaggacaaacaaccaaacaccgcatgttctcactcataggtgggaatcgaacaatgagaacacatggacacaggaaggaggacatcacacaccggggcctgttgtggggttgggggagtggggagggatagcattaggaaatacacctaatgtaaatgatgagttaatgggtgcagcacaccaacatggcacatgtatacatatgtaacaaacctgcacgttgtgcacgtgtaccctaaaacttaaagtaaaataaaaaaaaaaagacggctttgtgtcaagggctatttatttagtgtctctcgttcccattattaaataatttaacaacaaaaattgccttttctatgaattttcaggaaattctaaccatcattcctttattaaatatctagatatgtacatctacacatatgcatatacatgtgcatatatagacatatattatattatatatatttgtgtgtatgcatgtgtgtatatatttatatatatatacatgcatgtgtatatacacacacaaagacaaattaagaaatatgggaatatagtatacttctttaatttcttaataatgtccatttatatctaaaaaaaagatacccctaaggttgaaccactagaatcattttatttttaatgtggaacaatagaaagcttatggcccataaagatattggataacatatttttctagcaatatgagaaataagcaaaagtgtaaaacatttaaatacaataatttaattcaaaaatatgaaataatttgtattttttagttgctatgtttatctaccaagaaggcattatattattctgatgttcttacacattgttgaattaaagcttgttaaatacaaatgttatcatatgtgcaaatagcatatcaacatttctttttctctcatatattttcagaaatcactttaaaatgtagcagttcataatgttgacaaaatatcaaaatctataaactctgggtttaaaaaacaatgaaatacacagtacacataagaaaatagtgtcaaagctcactactataagagacaatgatcaatattgaaattttctcttacatgaagacgctcaaaacattttagcagtgactagtgaggttgtatccattctcttatgtttatatttatgtttaaaatattgtccttgagaaggagtgtaggtaggtataagcagaggtggctgtgcggatccaagattctagcctgcccccttgatacagcccattaccctagtcccatccaatctcacacatggcccatcatcatcttctgacttgagcggggagagagacggtgggtagagagggaggaaaggagttagttcagagcataggagacgtggtcagagagttggcagagggagggagggaggcacattctgtgggttcacgtggtgctttgacaactgtggatttacttctgaatgaagcatgaagtcattgagagtgtggaacagtaaaatgatattgcaaaataaaataaactaagattccagtgagcatgttgggaatcacaaacactcacagctgggtgaataaacaagtgctgccatctggagaaaagttcctcagcacacaaggagaagtgtgtttgcctctgtcaagcagaagtccacctatacagagacacaaggaaatgtttataaagagatccttattcggagcaaagtattggaagcaacataggtgttcaacacaagtggaatttataacacaaggagaagataaaatgctagccagttggaagtaatacaacttcttatgcgacacgaataaaaatataattatcagttgaaaaacaataacaacaaactcccaccaaattaaacaaaatcaaaagctctcaagaaaaaaacaatgtgccacttattttaaagcagaaacatgcataacgaattcttcaagcttatataacgggctttttggaaagtagactggaggcacattatttcacataaatgggtgtcttaggaagagatggagacacgtataatggctaaaaaatgaaataaatccatagagaggtttttagtgtctagtgataaaagtactaataatattacgtaattaaattccaaaaaattaatacagaaaaatattcttgatttgggggtggtaacagatgattaagtaaagcgagtctacatgagctgctgatgcagtggatgacaagctctctgcagctcattgttagtgagaaggcactgctttgccagaaaccccttttatttagatttctcatggtccctgggtccctctccaacaccatgagcagcttcagaagaggatcaggataaccagtgactctctggctaccatggcccagttgtgtccgagaggtaagaaaggtttgggatcttggacagagtgggacagtgggagaaattcctgagatggccccaaccagcctggaaaccactcagaacctgcattgaagtttagccatcagggtgctcttgagactcggtttgggctgcaacacagacctgtggggacaggggtcaccataagccaggccacctccacccctgggtcagctcatctcctccctctctgcttcagatctttgagtaaccagcacatggaggcccgggaaaagtcagagagcaagatcttatttaaatgctgtgactccacccccatgaaggctttgggagctataaaaaagagacttaggggagcccagtctccaaacagagcttcagcaagcatagtgggaatctgcaccatgccctgggctctgctcctcctgaccctcctcactcactctgcaggtgagagtggaccttacccagggatctgcacccacctctgctccagcttctccactccctggctcagtggactctgatcctgctctcacattcctttctgtcccctctacagtgtcagtggtccaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcacacagtgcctcaggccagtggggaagtgagataaaaactcaagagctccctcggcctcactgaacaggcctcacagagcactgtttaaactggaccacccaaaagacaagggatgcattcacaatagtgtacactatttaggactgttaaaaataggaacatgaagtgaaattagcaagcctgccttattaacaaatgtgtgtagggaacatcattgtttatatattagtagttacatatatataatactagtgcatgaacatacatatgcactagcaattagtaaaaaagaaacactaggtttaactaaggaaatatttattattccagagttttcttatccattccatttgaagatgctgggatcaagtcaccgagggtgctgctctctggccttgagaatccactcagcagggccaccagcagcccctcccttctgtggcctgctcatgccctgtcttctcattagaatccccttccctgctgtcacagggatccctggactcctccagatccaaatatgtccaatacatttggttgaggcctcctgggccccacattactgtgtaatctcaacacccacacactcaaaacagtgttcccatgcgtattcttctttcgactcatcactgtcctctaacagccatgggcagtgtgtggagagagcaggtgaagttggagctttggggtacagttgacagagatgttgacattttgagaaaaagaaaacacctatatagctgttttcaggataattttccatcaagataaaaatccacgcatgagagcatcactcttccagtgatgaatgcatggaggatccttctcactctattgttgggtagtgacacctgggaaacttactgtgttatttagtgtgcagacagctggtaaaccactcagctgactctagggaagttgaccaaacagtgtccccactgatgtgtgacttttctccacccatgaggccccactaccctgtcacctcctgagtccacctttcccattgcgttgctttagatttgaggcatctctctcttacctctttaaagtctttacccaagtctggttcaggaagtgctgatacacggtgagaacccagggtgcatatggatggagtgattctgtgcctaggagagcctggccaggggatccaacacagcttgtggccatcctccccgcagtggagcttctggagacagagctctgaggtgtccccaccacaccctggggcctttctccctcagttctttataaaagggatatttgtcatgggcttaggggaagaggccgctgaggtcacacaagacctgccttcttgctctggctcacaaggcacaagtgagctgtgaccctggactctgtgtcagtgctgtggtcacttggtcagaactaagggaagctggagaaatgtgggtagctttgatgcagtctggcaccagaagctccatcctgaagcactctgaaggtgctgatggctgttcactgtgctgcaccctgagcaggaggatgatcatcatcgcagacctagggtgacagcctcagagctgaaatattcctcctggccctgagaaaagtgggctaaagttctcccttctgcgtgtgttacccagtggtttgcccccctttcatcacctgtgaccaacatgggctcattggggatatttgtgctgtcatttctggcacaagaacccaaagatctaagaccataaaatgcatttggtctttcatactgtctattcccatcagggcagacatctatccattaatacattttatttaattttcttgtcttatattttcagagcaatgatgagtaatgagtgaggtaaggggtacctttgcatttttttgatctcagggaaaatgtcctccatgcagtaagatgatgactccggaccaagacaggtgtgtgtgtgtgtgtgtgtgtgtgcgcgcgcgcgcgcgtgcgcgtgcacacgtgcacacgcatgtgtgttaccatatcataaacaaatttatctgtttctgtattcttacgtgatttttattagggatagatattaaaatttgccaaacacattaaaaatctattgatacaatatgatctttggttgtgatgtaataatatggtattataccaaaacttttattaatgttgaacccaaccattattttaagtataaatcccacttgacaatggtgtataaatgcgtaaatctggtgttgaaatcagttcgttcctcaaatttcctggttcaagtgatcctcccacctcagctccttgagtagccgggattccaagtgggtgtcaccatgcctggctaattaaaaacaaatcttatttgtctcaacatattgcccagtctggtctcgaactcctgggcacaagcgatcctcctgcctcagcctcccagaatgagttaacattttattttaaaattttgcattaatatgtttattttattttttatttttaaaatttttaacttttattttaaattcaggtggtacatgtgcaggtttgttacaagggtatattgtgtgatgttgaagtatacaattttatctttttaaattgctcttaatacatatttttaatttaaatttcaacttttattttaaatatagcaggtacacgcgcaggtttgttacatgggtgtattgcacccgggttgtgagcattgtacccaacaggtagttttttacaccattccctcctctccctccccctcctagcagtgcccagtgtctattgttctcatgtttatgccatgcgtgctcaatgtttatctcccacttaaaaatgagaacacgtggtatttggctttctgtccctgtgttagttgcctaggattatgtccccctgctgcatccatgttgcttcaaaggacattattttattcctttttatggatgcatagtattccatggggtatataaactatattttctttatccaacccaccactgacgggcacctaggttgatcccatgtctttggtattgtgaatagtgtggtggtgaatatacaagtgcatgtggcctttgggtataatgatctatttgtctttggatagataccctgtaatgggattgctgggtcaaatggtagctctgttttaagttctttgagaagtcttcaaactgctttccacaatgcctgaaatacggtgtatacgtgttttctttactctacagcctcaccatcagctgttgtttttttactctaattatagccattctgactggtgtgacatggcgtctcattgtggttttgatttgcatatcttgatgattagtgatgatgagcatttctccacagttttgttggccactaatatagtgcagttttaagttcatagcaaaatacagaagaaggtagaaagatattccctatcctccctggctccacacatgtccagccttcccccttatcaacgggtcccatcagaaatgtacatgtcctgtaattgatgaaccacattgacaggtcattatcactacaagtcagtattttccttaaggaatttttctcgctgatgcacatcctatggctatgggtttgtgcaaatatataatgacatatatccaccattacagtatcatgcagtgtatttcccttccctacaaatcttctggctttactgattcatctctctctctcccctaacctttggaagtcgatgacttttctacttttttcctttgtttgactgtaatacacttgaaattatttccccctttttggactgtaatatacttggaatcacgtatcatgtcatttgcaggtcagctccttttacttactaataagcatttaagtttcttccatgtcttttcgtggtttgatagtgtgttgtccataaacatgtagaatatattaatataaagtactttggagctgatcacatcactggccattcaggtttttcaattactgtttgttgaatgacagtgaccagtcagatgacaggaagtcttagaccccctgagaacacagaagatggactgaggatgtcagggtcaccgaggactgcactgggtgctctcatggagggctcagtaggggtgtcctctagttccagtgagcctggactgtgatgggcactcagagaagggtcctctctagcctagcagagcccctgctcacaggcctaccagctgtcccagcagctttccctcccaggtccttccgtggggcagacagagtctcactgcctgttagcccttcctacccacaagaccctcagcaaaagatccttattcagtgctcagggagaggtggggcagatagcagctggggccacacctgcatgaccagctcctcctcgctgaggcctacagcaggtaataaactcaatccatcccactggaccaaagggagctgtgtctaccatggcctggacccctctcgtgcttgtcctcactccctgcacatgtagggaaaaggcctagagacctggggcagttcccagcttgtgtcagcccctctggctcagacttgccaacagcttaaccctgacacctgctccaacaatgtaaatgtttgcatttccaggttccctcttccaggctgggctgacccaggtgtcctcactcccagcatcttcatgcagatcaaacactcacctgcactcagagcatatcggctttcatatcggtggcaaaaataccttcttttccctacagaatccagggagccctccaactatgttctgagattatgctcaggctaaaatgagtaccaggcctctggggtccccagacaattctctgggttgagaggctcctccagagtctcaagttatttggtcgtctctggccttcaccttgaggatggagcagatcatctctctcagatgggctgacagggcatggcttacactgtgctctaggccaatgggaaaatcccctctgcttgtgctgcctgggctcccactaggcccctgctgtttgtgacaacagccagcactggtggtgacgcttcagccatgtatgccctacggtgagagtctgcagcccttccacgcaactatcacttgcagaatgtctgcatcattgctaatagcacattctgagcctcctcacgtttctgtgggcaacaatttccttcccaagacgtgcacatgatacaggagatttatttaccaaataagtttattaggaatccaattataattagaagatattcatcagtgatcgggggaaatacctggtataattaaaatagaatttgatgaaaatataaataaagaactaaattatgaaggtgtgggcagagagtctggacaccctaagggagatggaaaaccattcatccttgccaggaatgaatgtctctgggatgcttctctaacaggaggaacctggagtgagaccaggaacctggagaactagcagctgggtgactggaaaggaaaccatctggggtggggttgggtctgcaaggcaggaggtgtctgggcagagaaagcagggctggggcggagggtcctgcctcatcccattctcctgctcactccttcctagatccctgtcagggcagtaaccatgagcaaggcttgaggctacttcttataaactgtggccctgggcacattccttagctcacctgagcctcagtttcttgatgagaaaaaatcgggacaatagcaaccaacctatctcagagggctgctgtgagaccctgagccactgtttctcaaactgcccctgagatcacctacaacagaatggctgtagggtgaagtttgagaaccgcagtataggtgaggtggtgcgtggggcaggccctcccacactgtaaagtgcagtgtggtgcggtaaaagctgatattcccgcaggcatcctcagagtgggcccaattagactcttgagcactgattccattcaaggtctgcggcttagagaggatggcaaagtgaggcaccaccaggagcttgtccctatgggctccaggccaaggacgtgcctggagatgactcctgccttgtggcgctgtcactgcctcactgtccacattccatcacgcctcagatcctggcttccaccctggtgaaaggaatctttcaatatcacccacccagccacagacgcttctctgcttctctggcaaggctgcaccccctggctaggtgggcagggccaggggctccttgagacagtctgcagccactgagctctccagcctccagggcagaggtacagtcccatggagcgtggctgatctgaaggcagttctggcctaaaaggggtcttgtcccttcctcgtcctcattgctcccaaggccaggttggcagcagtagcagcggggttggatgctattggatgggagaaggtgaatggactcggagtgcagaatcaagctgcggaagccaagggccttgaaggagggtcacacacaagggacaactgcagaggaaaataaaggaacactttgtgattagccctgcctgtggctgaaagcgcagtgcagaagcatagtaaggaaggactgggtggtctgggtttaagacctaggaaccgtctctgctcctccaagcctgaatgagccctataacctaagggtcctggaggtcttgaaaccttctgcggagaaggctccaggtccactgggccctgtgggtggaagagcagagtcacagccccgcactggggacctaacaggtgtggccttgctagggccccagaatgggaccagagtgggtgggagggggcagaagctctgagagcaccccctccttcctgaagcctgtgcttctgagacacatcccaggaccctctatgtggttccccatgtctctgtattttcattcagcttcgagtagctctccaaactgtgttccagggaacccccgtgttaacctgtgagggcctccaggaagggggtccaggtggggtatgcttggtgggctctgggtttccttacaggagctctcatataagtcctggtgcagcctgggaatctactactgagttggggcgggggcgggtctgagtccgaaacattcctgacctgcccctcaaagaaaggtcccactgaacagtctggaaagctgttttgctgagctcccgtcatcactcaatgaggcacgggcggagtgtggagggagtttccaacacacagtggatcccgcacaggtgtctctcctcgggtggctggggaggggagcacaagaaggcactgaggtcagagggcagctgccaccagcacctggcaccacagggcagtctggcctacagggtattttctaaacctggcatgtgaatgggttccatggggcacccagctgcctctaagaccataaggccttgttgtgagaatgggaattgcagcaggtcctgggaagctgccagacgcacacgggcaccatgtacagggcttctcagagatgggagcagggagcaggggacggagaagcgtggggtcaagagcgtggccctgagcagggggctgcagcgaagaccaaggggattcataagccagatccagggagggggtctcccagccccacctgctccactaaactcctctcctgccggagccacagctgtcaaggccgccttccttaaggcatcagggccactgcttgtgcacacagctaccatcagcagcacggattgagatggggtgtgagtgcaaactgggtctattccccagggcttcagggttggggcatccctgcccgtactgccagggtgtagggatagcagggagcactctgggcacgtgtatgcaggctgaagggagacgtattgggtttcggagagggaaagagggccccacaggtgcccagggacacggtaacgctctgacatcgctgcaccagcaaaggggccccagctctggataagataaaatgcattttaatagtttgaagtgccatgaggtgtctgcatggcactgcagcctgggtgagggaggacagggtcatcatacaaagtaggcggccagggctgacatcttgtccttgggccgtctggggttgggcttcccagggggcctcctggcccggccccgccctcgaccctgccttctccctggtccaccgcggtgcatggggtggcaggaggccgcatgcttcagctccaccagctcctggaagacggggtcacaaaagacgcagcccatgtgctgcgcctcatcgcccgggagtggggacttggccttgttgaagtccacatcaagcaaggcggcctcacagacactgcaggtgtcggcggacacccgcacgcggtgggcgttctcgaagcagtgcgctaccacgttgcacttgttgcaggccaccttccacttggggcccgaggtggggtccagcaccagcaccccgctctcacattccacgcactggccgatgcccagcatgctcagcgagtgctggcaggaggggtgcgtacactcgttgcagcccatgcctggcgggagaagggagccctgtaaaggcacgcccactgtgcccacctgccctctgctgcctgctcccaatgcctcaagctcctggatccctcgtcccagcagaaggaactcttcttggccttgctcttggggacagccttgctcatgtttcggctcctggctgccattacccctgttttctgcttacctgaaacctcctcaactttcaaggcccctcgctggcgccatcccagtgggtttcagctgactccatcccccctttgctttgctgccagcttgttactggtaatgccacatgaccctcatgtcactgggccacatgggaccaccctgtcagctactctggcggcagcaggagggcagggatggggtctcactcccggggcagcctgggtgcagactgaggcctgagggggctttctgcagagcacacggtgaatgtgggcagatgcctcactcccgctgattcctggtctggctcggtgctctgtcctgcctgcctggacatgcgctccctcctccagtaatgaggacgaggatgaggatggaggacagtggtggacgctgactgggggtgcccgctcaccgggtgggtcccccgactgctgcatcctcttgctgactcagctccagagggagcactgcacacctgcgcccaggtcctgagggtggactagggttgcctgctcgattctgacacagagagagggtggcaccactggctgaggcctaagcagtgccccagctacatccagggtctctcgtctcagtgccaatgagtgcaggaaaggccagggtgaggggtcccctcagagtccagcctggtgcaaggcaggggttggcactgaacagagactgcagctacctgtggacaggagggagcggctgcactcaccttgatgctgctgttcaacaatggattgctgttgcgcctaaccaactttaagacttggtgggcttgacacaacttaccttgtgataggcagatgtgaatgtgtggtcaacaggtatcttatggtcctccgctagggccaacagcactgcagaagttgttttacaaaacacatgcaattcattactgcagactgcacttagccctgctaagtgcagggctggagggcctgtgctgtgattctcccactggagctcactgcaaattccacatggcatcttttcttaccaccgacccctccagtcccctaaattctgccgagtcttatggcccaagcagcagggctgttttcactgcagccttgtcaggcagcagatgacttttctacgccaggctgcattcaaaggtggcagccttctgtagaccaacgacataggccagaagtggaacatgctgttcccaaaacctgaagagttctgccaggcattatgtttggacgatctgacccatcctgccttgaccacttaggcactcaaaactgtactcacgtgacagttccctgaatcttcatacagattatctcctaccctttatagtgcatgtttcttatgaaggcctccaacatgctagccatttcctactaaactaactcaactagcatgatgtcaacaacacagtcaatcaatgggatattttgtggggtgctcagatggcagaatgctcccacatcaataaaactcacccttatctaatcttcatgttctggtccccctctatcacccaccctcatgatccagtcccatgcctagtcccttgactcctgctggtacctgctggttaggtcttatggctcctctggtgtgtagtcccttttcttccccttttaaaaaatgttttgagacagggtcttttctgtcccctagactggagtgcagtgtcatgatcatggctcactgcagctttgacctcctggggtcaagtgatcctcatgtctcagtctcctgagtagctgggactacatgtgtgagccgccaagcctggctaattaaaaaaaattttttttttttttttgtagaagtgaatgttccgctatgttgcccaggttggtctcaaactgctaggctcaagtgatcttcctgccccaaactcttaggctcaagtgatcctcctgattttccttatccccgtgagcctcctgaagtgctggggttacagatgtgaggcacctcacccagccttttctctcttctcaaaatgagcacatctcctgctgtgttgtgctgggacttaaccctagttctaggccaagagggaaattgggcaagatggtgaagaaggcatattttgtcctagtgagagaggcctctgcaaacaaaggagtttagctctgaataggctgagtttagtccacttctgcaggctcaggggattaaggaaaatcagtgacttaagattttagaggcctcaatccaaataactctatcaatatatatgagggtgttggccgggcacggtggctcacgcctgtaatctcagcactttgggaggccgaggtgggtaaatcacttgaggtcaggagtttgagaccagcctggtcaacataaagaaaccccgtctctactaaaaatacaaaaaaagaaaaaaaaaaaaacaaaaaaaaacaaccctggcggggcatggtggcacacacctgtagtcccagctacttgggaggctgagactcaagaatctcttgaacctgggaggaggcagaggctgcagtgagccgagatcgtgccactgtgctccagcctgggcaacagagcaagactctgtctcaaaaacaccaaaaaaaaaaaaaaaaaaagaaaagaaaaaaccctgacttttctccagcagtctggatcaatcaccccaaacagtccagtgacccctgatggttgagcagcagcactagaaccccaaatttctaggggagacccagcttccagtttattaagttccatgcacttaattcttgttctgcttgattttgggtcagcagttacatgaactcacgtgtttctcaaccagtgttctggagatctggctcagtgcagggctgtggtttcaaagttattcaagcaatgccaccaaaagcctgtaccccagaatacctgccataggccatcctgtctatccctggagacagtcccttcttattgaagatgaagcactttggcccgtagctggttgccagagctttcagaaaagcgtcggagtaaaacaaccatctctgatgacaaaagacttaaaatggctgtgaagagctctattaattcctcaaatattcattgctctattttttatctccttttataactcctactgccaggctattggcctttctacttctatcctctccccgacattcccatcttagtaaatgactccacaagtacttcagctcccattcaaggaccttggattacccttgggtcctctctcttactcaacagcccatcctatgccaagtctcaccaattcttctctctctctacacacacacatatacaaacttatttgtaaacaattattttaaaaaatctctcttctgaggttccagctttcttcttcttttatttttttgagactgagtctcgctttgtcacccaggctggaatgcagtgacacgatcttggctcactgcaatctctgcctcctggtttcaagtgattctcatgcctcagcctcctgaggagctgggactacaggcatgcatcaccacgcccagctaatttttttgtatttttagtaaagacaggatttcactatgttggcctggctggtctcaaactcctgacctcagataatctgcccaccttggcctccaaagtgctagtattacacgatgagccactgtccccagcctctctctcttttttttttttttttttttttgagacagggtcttactctgtcgcccaggctagagtgcagtggtatgatcttggcttactgcagccatgatctcccaggctcaggccatcccacctcagcctcctgactagctgggaccacaggcatgctccaccatgcccagctaatttgtgtattttttttgtagatacagggtttcactatgttgcccaggctggtgtcaggctcctaggctccagtgatacccccacctcggcatcccaaagtactgggattacaggggtgagccaccacacccagtcacagctttctttttagagttcaccacagtttgagtgattatttggaatttttaagtggcaaaaattacaacaatatatttgtaaatgaaagagaattgtgaaatgtatttgaaattttaactttaagattttctttaaaatacccatattgaatgaagagtatcaaagtaactattgcttaaaaaatggggcttcatttgggttaaaacacaagaatcatgaacatgatcaaaattcttcaaagtgcttgcttggaatgatacagagaggattagcaaatacaaatagtttttttttgtttgtttgttttttttttttttttttttttttttttttttaagagatgcggtctcactatgttgctcaggctggtttcaaactcctgagctaaagcaatcctcctgtcttggcctccccaagtgctaggattacaggcattgagtcaccactgctggccaagatgctgatctttttgttgttgttgttgttgcctaggctggagtgcagtggcctgatctcagctcaccacaacctccgcctcccagattcaagcaattctcctgcctcagcctcctaagtagctgggattacaggcatgcgccaccacgcccggctactttttgtgtatttagtagagaggggtttctccatgttgcccaggttggtcttgaactcctgacctcaggtgatccacctgcctcaggctcccaaagtgctggtattacaggcatgagccaccgcgcccagtgatgctaatcttatgaaagacaaccaacaacaaattctgaatactaaagtgtgcgaaatgtatttaattcttttcatagcacagatgagttaacccacgatgtgttgtcccaggcactatggagtcatcttgaatttcatgttctaaacaaacacccttggcctggaggaatgcacctgcatatcacgacaggacctagtgtctcagatttagtccggcagctttgaatttggaaatcctctttggagcttcttctgacacagcatcttttctctctgggaaggtaggtgacacctgagaacagaggcatggtgtggcatcagagatggaggtaagaattatttttctaccacaatcccaggaaaagactctcctgttcctggtgagggtgagagctctggctgaggatgtcctctttcttctttcttctccagaggatttttcagtctctctgcaaatggctgcttcacagccagggttcatcgaaacccctggatcgtcatggccagtggtttgcgtctctccagcgccactccatacgagggtctttctgcatcctgctctcatggtggacttctgagggccatgctcctcatttgcagggctcacaaatattctgtaaatatccaccagtgttctgataacggggtgacccaggacaaactgaccgtctccagggttcaggtcccaggcatgtctagctccctctttcctttcactgaaaactaatgtcctgtttttttccgtatctatatggacctttctgggttcagtggtgtgggaaaaatagattgttggtgaagactcatcttcatctcctgaactgccatcattgcagtgttcagagtggggatggtgcttggaatcattcccttgaccttgccttcgaccttgcattagttttgactttaaaatgtccttatgaaaattcccccaagtacggaagcccatagtctcatcagagatcccaccttttccctgttcccctccatttttttttcttttttgaaatggagtctcactctgttgcccaggctggagtgcagtggcgtgatctcggctcactgcaacctccacctcccaggttcaagcgattctcctgcctcagcctcccgagtagctgggactacaggtgcccgccaccatgcccggccaattttttttatttttagtagagacggggtttcaccatattggccaggctggtctcgaaattctgatgttgtgatctgtctgccttggcctcccaaagtgttgggattacaggcatgaggcactgcacccagccccttcccctctgtttgtgaactccatcccaggatcatggttgagttcacccagcaggttttcttgcctctccagttcttccagtcgagcccacagttcctcatttgtaagtaagcatccttggacttgagatcattttcaaaacctgaggttttggattttgaatcaggtttatgtgcaatccagggttttctctttaattcagacttgttttgaacatgttttcttaggtcaacaagatctccatccccatcaccccatccctgcagatctgctgtgaatgcaactttagattcaaagtttctcctggcttttgtaaagtcatgtagtgctttcctcacacactccttcctatgctccactaaccccactgcttgctttgcagagcactggcaaaaccagttgtccccgaggagaagagtgattttgctggtatccacaagccttcctggtatagaaggcaagaggcccagttggcaccatgagctcgtaagacagcctattgggcaaggtttggagtcgctcttggagggtattacagtccccctttaccttttgccagtgtgcaatttcatcttggcacctagagatcatcttttcctgttctccttggggcctcataacctgttgaggatgcagctgtttgaaggtggccgaggaggctgcacggtggggcacacggtggggctccatggctcctggttctgcgtgtgcgctgtggtcggcactgctcaggctgctgcccccagtcatggcgactgcagtgcccaacttcctccagctgagtcctcatgagatccttcctgcaatcagtgctcccagctcctcagtcccttcaaaagataaatcattccggagatgggcggtggtgatgtagcatgacaatgtggctactttcaatgctaccgaactgcataccaaaaaatggttaaaatgctgaattttatgttatgtatattttaccacattaaaaaaatattagctgggtacagtggctcacacttgtagtcccagcactttgggaggctgaggcaggaggattgcttttagtccaggcatttgagatcagcctgggcaacacagtgaaacccccatctctacaaaaaaactcacaaaattagctggccaagttgattgtgtgcctgtaatctcagcatctctggaggtggaggtcgggggattgcttgagcccaggagttcaaggcctcagtgtactgtaatcacaccactgcactccagcctgggtggcagagcgagatccagtctccaaaataataatagtaataaataatagtaataataataaataaataagtgataataaataaaaatatccacttgggataattatcacaagaactttgctgtcatggttgtgattttttggaacaaattctcatggttctaactaaaccaaatcaaatacaacattgatttgaacgcccatgctcacagcagccttattcacaaaaaccacaaggtagaagcaacccaaatgtccatcgacagatgaatggatcaacaagatgtggtctctccacacaattcagccttaaaaaggaaggaaattccaacacatgcgacaacatgcaggaactttgaagactttatatatactaagggtacccaccccctacctcactgtattcatatgttgaaatctcaacccccaagctgatggtattagggtatgggattattagattcaaagtttgggacataattaggtcatgagggtggagctcccatgatgggagttgtgaccttataaaagggattccagaggcccctcttaccccttctgccacgtaacaatacaacaggaagtcagaagtctgtgaatgaaagagggccctcaccagaacccaaccatgctagcccttcatcttggacttccagcctccagagccatgaggtatcaatgtctgttgtttataaaccacccagaccatggtactctgttatggcagcccgacctcactaagacactaatcaaaacaaaccggtccacaaaaggacaaacactgtatgattccacttacatgaggtacctagagtagtcaaattcctacagacagagtagaatggtggtttccaggggctgaggggagagggaaatggagagttgtttaatggcatggagttttagttttgccaaataaaaaagttctggattagttggacaacaatgtgaatgtacttcatgcttctgagctgtacacttaaaaacggttgcctgggcatggtggctcatgcctgtaatcctagcacattgggaggccagggcagaggactgcttgagccgaggagttcaagaccagcctgggcaacatagcaagactctgtctctacaaaacatttttaaaaaaattcaccaggtgtggtggtgcacacctgtagtcccagctacttgggagtctcaggtgggaggactgcttgagtctggatgttcgaggctgcagtgagctgtgatcacaccactgcactccagcctgggcaacacatagtgaagccgtatctttaaaaaaaacaatggtgagactgggtgcgttggctcacacctataatcccagcaccatgggaggctgaggtgggtggattgtttgagcccaggagtttgagaccagcctgggcaatgtagcaagaccctgtctccacaaaaagttagctgggcatgatggtgcatgtctgtggtcccagctacttgggaggctgaggtgaaaggattacttgagcctaaaagattgaggctgcagtgagctgtgattatgccactatactccagcctaggtggcagagtgagaccttgtctcaaaaaaaaaaaaaaatggataaggtggtaagttttatgttatgtgtattttatgttttttttattttttaaagaaacagggtcttgctatgttgcccaggctagagtgcaatggctattcacatgtgtgatcagagtgtactacagcttccaactcctcagctggagttgaggtgattctgcctcagcctcccgagtagctgagaccacaggtgtgcacagctttgcctggctccattttactacactacagtgtctctctttttacatggttgttgcagtaaaagaaaattcagtgtatatagaaacatcacaagcaattgttttaagattatatgtaaagtggaaataagttgtagactcatatagttgtcaataggttttctaacataagaactttgggtggggcacttgagaactgattcagatggaagatggctctaggctggtggaacagtgttgagaattcctgaatgtgtagtattcctagacctctgtccaccaaattaaagcaggtcccccatcaccatgatcctacagggggcatcccccttagtaacccatggaatctggcccggcctctttctctagcctaaattgagacattctcctccttgtttctctaggcctcagccacactggccttcttctatttccaaacacacaccaagctctctcctgaaacacagccttcccacacaccgcatctctgcctagttcatacactgccggcaaattgtgtattggggctgggcccttcccactgttcagctgtcatcctatttttttcctttgtcaggggtcctttgaaaactacgtattccagaccaggtgcctggacattctctcttatgacacttattaaaacatgttgttggctgggtgcggtggctcacgcctgtaatcccagcactttgggaggccgaggcaggtggattgcctgagctcaggagtttgagaccagctgggcaacatggtgaaaccccgtctctattaaaatataaaaaatcagccgggcatggcagtgtgtgcctgtagtcccagctactcgggaggctgaggcaggagaattgcttgaacctgggaggcggaggttgcagtgagctgagattgcaccactgcactgaagcctgggagactctgtctccaaaaaaaacaacaacaaaaccaaacaaaaccaaaacaaaagaataaaaaaaaatgttgttgtcattattttcccgctagactcccacaagattccccactagactctaagcttcatgggaggaggggctatgcacattcacagtgtctgctcttaccagagagtctcacagagcagccctaacaggttagaccaaagaacaggtcatataaaaacccaagttccaatttctcctgagatgtttttctcctaaaaaccaagttaagaactctaggcctctactgggaagctgcctccccattcagacagggtctccccattaccacaatcccttctagtcctctcttctacttgcctccctaggtgatcattgcaggcatctgagtttgtaaacccgagtttacaaaaggggattagagaaatgcccacatcaaatgatctcattcacccatttctcagattctaggtcctgatggttggcacatgttgcaatgagttggatggggggagtccagccaggacctcagggtagccacagacttcttcaatttccaccctctaaggtttggtcctcagattggaattatgtttcctcaattctctgcagacaggaagtgttgagatctgactcttagtagtaatttaaatgagagaaagagaggaggagggaggtatttttatatcctatttgtatctaaataccagaaaaggtagggagtgggggcttacacctgtaatcccgacactttgggaggccaagacgggagaatctcttgagcccaagagtttgagaatagcttgggcaacgtggcatgaccctatctctacaaaaaatacaaaaattagttggacatggtggcatgtggctgtagtcccagctatttgggaggctgacatgggaggattgttttagcctaggaggtcaaggctgcagttaactgtgattgtaccactgcactccagcctgggcgacagagcaagactgtctcaaaacaaacaaacaaataaacaaacaaacagaaaaacaaacaacccgggaaaatggtactttgggaacaaggaccttggtcaacccaattccttattgaaggaaataacgtatacagtggtccatttcttttttttttttttttgagacggagtctttctctgtcgccaggcttgagtgctgtggcgtgatctcggctcactgcaaccaccgactccctggttcaagcgattctcctgcctcagcctcccaagtagctgggattacaggcatgcaccaccatgcccagaacatttttgtatttttagtagagatggggtttcacaatgctggccaggatggtctcaaactcctgacctcgtgattcacctgcctcgacctcccaaagtgcgtgctgggattacaggtgtgagccactgcacccagcctacagtggtccgtttctaagacaaaatgctttgaattggcttaggtcagcaacctacagaagaaacatgatacactaggtccctgcttggatagccagccaatgcctgcttgtcagcctcccccttccccaccttcgccccttagttgccttcacctgaaccaaagtagtttagtctaagatgaaagtttactagcctgcaaaatagcttgttttgtctgttcttagcctgcccagctacttaggtcataagtctaacacttgaagagcccctaagctaactaagattacaatgcattgtgggctgcaacaaaatgcagcaaaacgaccctaaaataaacaaaaaacaaaaaactcctggcgctcccacccaacaatcaacaggcgagaagtttatgaccccgtagtactcagcctatgaggaactgggggagggacctgtgcactaggggataaactgcttgttgaaagtgtgctgggtgtgcctgtcagacacctgatcttgcaagactgtcattaaaagtctcactttcactgttctccgggtctccgagtccattctttgggttgggatgggcgagactgtttctcacattatgaaaagctgaaggttaagtgaacttggggaatactgcctcctgctggctggatgtcatggaagcctggcccatcagcagagaatgataagctggagttctggagggtctgatttccaaggaatcacccccttggaagctcctctaatacaccctgatgagattaacctgattaggtccattgtttgataaaaagaggaggaagtttaatcacttccacattctttgcccacgactaaccctgattggatttggggctatggttcaaatgtatgaccgattgatttttttcacttcttctgttggacttttgaaaaaaagttctctgaaaaggaatttagaggaaagagacttattccagtgaacagttacagtttgcaaacccaacagacacaacttttggtacaaaaggaagttacattccagagaacaaggggaggctttgtcttttctagagaaaattcccgctcagaatcccactcaggtctgcttatgcaaatgaaagattcaaactttttagttctgattacttggctctagctgggttctgattagtcaaagcaggtcacagtctactggtggcgtaaacaggaacaggcagctatgtaagtcccaaagtttttccagaaactcaaagtatgtgtgtgacctctggtcagcaaataaccacttgtctcaaatttaaattcaggcccaggattcatcttgaggaattggctctttcagggttcagagaccaatcaaaatgtctatcagaatggatgtgttaaaaggcaaataatgggcagggcatggtggctcaagcctgtaatcccagtactttgggaggccgaggcaggtggatcacctgagctcaggagttcgagaccagcctcgccaacgtgatgaaaccccgtctctactaaaaatacaaaaaaaattagctgggcgtggtggtgtgcgcctgtaatcccagctacttgggaagctgaggcagaagaatctcttgaaccctgggggcggaggttgcagtgagccaagatcatgccactgcactccagcctgggtgataagagcaagactctgtctaaaaaaaaaaaaaacagcaaataacgttgtcctgtgccatgagccacatactcaaatatttacacaggtccaggggaagtaaagagtaaatatggccaccaggcgcggtggctcacgcctgtaatcccagcactttggcggctgaggcgggtggatcacgaggtcaggagatcgagaccatcctggctaacacggtgaaaccccgtctctactaaaaaatacaaaaaaattagccaggcgtggtggcgggcacctgtagtcccagctacttgggaagctgaggcaggagaatggtgtgaacccgggaggcggagcttgcagtgagccgagataatgccactgcactctagcctgggcgacagggtgagactgtctcaaaaaaaaaaaaaaaagagtaaatatggcctgatgtgaaaaaaaattataaccaccagaatttcctaaaatgtattttattgatctatagtgttattgcacaacatccacaaatatctatgatgacaattgtttaaaattcaagttaaaatacaaaatttaaaaaagtttacctacttttacgttgttaatttatgactctttgggtttgaaatgagatttgatgtcattgtatttatagatattccttgacttcttgtgttatgtaccaataagcacattgttaagttgaaaacatcataaataaaaaatgtgtagctgggccaggagctatggctcatgcctataatcccaacactttgggatgccgaggcaggaggatcacttgagctcaagagttcaagaccagcctgggcgacaaagcaagacccccatctccacaaaaaattaaaaaattagccagttgtggtgctgcatgcctggggtcccagctacttgggaggctgaggcaggaggatcatttgaacccaggatgtcgaggctgaagtgagctatgacggtgtcactatgctccagtctgggtaacataatgagaccttatttttaaaagaacacacaatgagtagctgagtagggctgcggctcactgccactgccagtgtttgaagaacagttcccactgaatgcatctcaattttgcactgtaatcaagtagaaaaactgtaagtccaatcattgtaagtctgggaccatcttgtccatagtcttatgacagaatactgtttaaaagtgtagatctatccgaatgttgatgaatttattgtgaaatgcttccccttgtgttgcttctatgtgatctatgtgcagcagtggacattttttttttaagtgaaaaacaaatcatgcccctcccttcattctctcccccgtgatgtttcccttagagaacattcctcccttcccttcccagtccccacctcagagatggggcaactcctccctttttatcacacttcttccactctgaggctctaggcaatcagttctcggtcactcccacccatgtgaaggtttttttttttttttttttttttgagttggagtctcgctctgtcgcctaggctggagtgcagtggtgcaatctcggctcactgcaagctccgcctcccgggttcacgccattctcctgcctcagcctcccgagtagctaggactacaggcacctgccaccacgcctggctaatttttttgtatttttagtagagatggggtttcaccatgttagccaggatggtctcgatctcctgacctcgtgatccgcctgccttggcctcccaaagtgctgggattataggcgtgagccatcgcgcctggccccgtatgaaggtttttgatgatgcttgctagaatggacccagataattttcgtgtggacagaaggtagatttttagtagctcttgttagaggtcatgtaggagattgtctcagcttgagctgctattgcaaataccgatactgtagactgggtggcttgaaaacaccagaaatgcattcctcagagttgtggaggctggatgtccaagataggacaggtctgagatcagggtgccagcatgcttcagttctggtaggaatcctcttccaggctacagactgccaacttctcgtgtcttcgtgtggcagaaaaagggctaaaaagatctctgggattttttttttttttttttgagacagagtctcactctgttgcccaggctggagtgtagtggtgtgagtggcatgatcttggtatactgcagtctccacctcccgggttcaggcaattttcgtgtctcagcctcccgagtagctgggactataggcgtgtgtgaccatgcccgactaattttggtatttttagtagagactgggtttcaccatgtttgccaggctggtcttgaactcttggcctgaagtcatgtgtctgccttggcctcccaaagtgctggggttgcaggcacgagccaccgtgcccagcagggcctcttttgtaaaggcactaatcccattcgtgaggttctgccctcatgacctaattacctcctacaggtcccatgtctgagcaccatcacactggcatttaggatttcagcttatgaattttgggaggacacaaacattcagttcataacagcattgtgttgtcacccacttttttttttttggtaggaacagtgtgtcgaactctggtctcaagtgatcctgctgcgtcagcctcccaaagctttgggattacaggcacgcactgccaaggccagccacatccatattcttaatctccaccatggcctcatgagcctggtcccctgtcagtgggctagggcctcgacatgggtaatacgcatattagctgaggttcaggaacccaactgacttgtgtaagaatttccagctggccccgcagaacaagaggctaaagagtggggagcagtgctagtgttgccactgctacagctctcgggcagtattcactaccctcatcctgtatgtgtgcccaggtgctgggtgagcatttcactccacacgagaggcatcatgcattccttcattcgttcgttcatgccgttatactatagtgaacaataaactcttgaggaatgtcgggtttaggggagccagtcccctgttcagttgaaaatctgcctggctatgtataaattttgactcccccaaaacttaactactaatagcctgctgttgactcgaagccttactgatgatatcaacagtcaattaacacatactttgaattttatacgtattatgtactgtatgcatttttttttctttgagatggagtctcactttgtggccctggttggagtgcagtggcaccatctctgctcactgcaacctcccagatttaagtgattctcctgcctcagcctcccaagtagctgggattacaggcatgtgccaccaagcctggttaatttttgtatttttagtagagatggggtttcaccatgttggccaggctagtctcaaactcctgacctcaagtgatccacctgcttcggcctcccaaagtgctgggattacaggcgtgagccactgcacccttcctgtactgtattcttataataaagtaagctagagaaaagaaaacgttattaagataatcttaaggaagataaaatctatttactattcattaggtagaaacagatggattatcctacaggaggaggaggaagaggagggggttggttttacagtctcaggggcgaaagaggcataagaaaatctgcaaataagtggacccacgaagttcaaattcctgttgttcacagttagtggtacacaggagacactaggtaagctaaaggttgggctgggcatggtggctcacacctgtaatctcagcactgtgggaggtcaaggcgggaggatcgcttgaggccaggagtttgagaccagcctggccaacatggtgaaatgctgtctctactaaaaatacaaaaagtagctgggcattgtggcatgtgcctgtaatcccagctacttgggaggctgaggcacaagaatcacttgaacctggaaggcagaggttgcagtgagccaaaatagtgccacttcactccagcctgggtgacagagtgagactgtctcaaaaaaaaacaaacaaaccaaaaagattagctaaaggttgaactttcagtgatgaactaaacagaaacaatctcatagagattgtggacaggagaagaaacaagcacaggtgcagttaaaacccgtgataaatgccccggcagaaacaagtgttaggccaggcgtgatggctcatgtctgtaatcccaacactgtgggaggccaagacaggaggactgcttgaggccgggggtttcaagcctgcagtgagctatgattacaccactgctctcctgcctgggcggtagagaccctgcttaaggaaaaaaaaaagaaaggctgggcgccgtggctcacgcctgtaatcccagcactttgggaggccgaggtgggcggattacgaggtcaggagatcgagacgatcctggctaacacagtgaaaccccgtctctactaaaaatacaaaaaaaattagcagggcgcggtggcaggcgcctgtagtcccagctactcgggaggctgaagcaggagaatggcgtgaacttgggaggtggagcttgcagtgagctgagattgcgccactgcactccagcctcggcgacagagcaagactctgtctcaaaaaacgaacaaacaaaaaaacaaaacaaaacaaaacaaaaacctaaaccaaaaccaaaacgcagcatagtccatgagagaggaagagcagggcaggcctactcacctggggctgtcggggaggctgcccaggaagggactctgaagtgagcacctggaggaaggaggttagttctgagggactggaattcatcctggcattgggatcacgggcaaaggtcctgtggtgacaaggagactggtgcgagcctggcttagcaccatgtgagagcagaggggtggaaaggcactaggtaagcatgccttcggatgtgaaatgagggagacggggactgggggaccctgacatgagggaggaggaaaggagatgggaagaatgggtgaccagagggaccactagaccaccgagggtgagagcttgctaatatcagagccatgtgtaggagaatgaagtgcaatcttggatagacctccagtgcaggtggtccagccatcaatgaccataaccacatgcatgattgtaggtggaaccagaagaaccacccaggcaactcacagaactggggaactaatcaagtcttgttttaaatgactacattacgggtggtttgccacgtagcagtggatcgctgaaacagtttaaaatatctattcagccgggcgtgcggtgggtagctcacacctgtaatcccagcattttaggaagctgaggcaggaggatctctcgaacgcaggaatttgagaccagccttgagcaaaatggcaagaccctgtctccacaaaaagtaaaaaaaattagctgggtgtggtagcatgtgcttgtagtcccagctacttgggaggctgggacaggagaattgtttgagcccaggagttcggaggctgcagtgagctgtgactgcaccgctacactccagcctggacaacagagtgaaaccttgtctctaaaaaaaaaaaaaaaatctacaaaccaggcaggagcactgaatagctcctgtctcccctgagacccttgtagaccttgaggtctgttacagagctcaccaaccttctcttggtctagaattatctaaaaagagttgagtgcagccagaaaggactgaatacatggtgttcttcaatcccatcaaactgctgtgccctgcagatgatccctgagtccaggtgttggtgggttgaggacaaggctgagggaacagaggtgggaacagtggcccaggaccaggagaatgcagagttcagagtgcatgacctgcatctaactctagatgctccaggggtctgagaccatctccagcagggtctggaaggcccagtcattccccagcacgcacagtcaccactggatactatcttgctctgtgagtgatgcaaaggtcctgggtcagtgaagcctgtgaaacaaagttgggaccagagtgtctctacggttgagggctgggcttatttgctctctaagtataattgtaagagcaaatagaaacacctatcctctctgagcttaaaaggatcaaaaagctctgacagtgtcagtggtagggctagttcaggggctgcagtagtgctggtgcccacaggtggaaccttctcctgccctgattcccaaggactggtgctctcggaggggtctgggaggtatatttctctttcacaaatacgtgcacaacacatgaatgagctactggatgagggaataaatgaatgaatgagtgaaaaaagcttcctttctcctctccaggagttagcaatcactggttagttccccactgcccaccagcctgtgcagaggagggaggagcaacaggtcatagatgtggttgcagctgttactggacagagtggtcaagacatcctgtgtctgcagaggccctccccagccctcacctggacagtggagctgttggccagagaggcagtgggaagaagggtggggctcccagagtcgacccagcgggctgaaactggtgcagtctgcgcctcaccaggcagagaatggatgtggggcagcttgacaccgagcaggggctcatctgagcctcaggggtggttgctctatcaaagtgtttgcaagtaaacagtcccagtgcacacccagctgctcagtgccacctcgtgcacccagggccacttcagccttgatcacaggcctgcacaggttccaggggaggagacactccagctttttgagggagggtgagcatgtgggatcagagactttaagtccaaatttccccttaatttttttttaaatcttgcaggtagtatgcaaacatacatttaatgtattatttttattctcatttatttttttgaggcagggtctccctctgttggccaggctggagggcagtggcgagatcttggcttgctgcagcctcaactcaacctcccaagctcaagtgattttcccacctcagcctcccaagtagttgggactgcaggtgcctgtccgccatgaccagctaatttttaaattttttttgtagagatggggttttgccatgttgctcaggctagactcgaactcctgagctcaagtgatcctcccaccttggcctcccaaagtgctgggattataggtgtgagacactgcatccggctcccaaatttcccctttttataaggacaccagttgtactgaccggggccccacctctatgacctcatctaaccttcattaactccttaaaggccctatctccaaatacaggcacactgggggttagggcttcaacctatggatttgggggatgcaattcagtctatcacagtgccaagctgcacctgctcggtgagccagaacaggggtggggaaggcaccaggccctggtgcttctttcccatgcctgagtcactctacttggttctaggagggagaggagcatgggctgaaggcagtgctgcaacatggaaggggcagaacatcccaacccgctctgggcccccagtgtcttctgctgtacaaagcaggtgttttcaccccccgaggatgtgtcctcccttcctggctcaccaagcatttaaatgtagacagaaaatttatttatctggggtgcggtttcctcagggggaagttgaggtcacgacccctgaggtaccttaacccaaaggcctccagggcactggccccagagtctccagcaggtgcttcctccctgaatgcttccatatggcaagatcagagccacaaatgctgccccgacactgttccggtaaccgacgttgcagacccaagaaagtctgggatggtagtggccaggaacggggtgtgccacggccccacctctcagagcagggaggaggatgctgggccagcccttggggaccccaggcaccgtggccacaggagtcagagctctgcatgtctgcaccatgtcctgggctcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctgagtttggtctgactgttgtgcgacttcgtagtaccagccttgggcaaaggcccggggccccgggagactggcagatcactgtggtgagcactcacctgagtccttacttttgtgggccatgggaggcaaggggttgaccgaagcaccctggaggggcatccatgcccaggacaggaccctctggtgtcatctgattctgcccagcggttacagggcaaacaagcttagaaagcacctggtctgggcctccagggagaacaggagccaggtaataggcctagagtgggttctccaccttggtcctatcgacgttttgggctggacagttcttggttgtggggctgtcctgcggattgttgaatggtgagtggttatctgtggcctctacccaccagatgccccttcccagttgtgacaaacaaaaatgtctccagacattgccaaatgtccccaggtggtaaactcacactgattgtgaaccactggtctagatgagcaagtaaatgcatttacttatttgtacaagagagtggcaggtgtcggcaaacatgttctttttttcctttttttagggataaagtcttgctctgtggtccaggctggagtgcagtggtgcaatcatagctcaccgcagcttcaaactcccaggctcaagtgattgtcctgtctcagcctcctgagcagctgagactacaggcgtgcatcaccatgcttggctatttatttagttttatttttggagagatgaatgtctcactatgttgctcaagctgatctcaaactcctgagctcgagtgatccccctgcttgggcctcctaaagtgctgggattagaggcgtgagccactgcacccagcccattttctataaagagccaggtggtaaatatttttggctttgtgggctatgcgatctctgtcacaactgttcaattctgtcctagtagcaagaaagcagccacagacaaacatgtcaacaaagaggcgtggctgtgttcttataaagctgtatttacagaaacagatggggctacactgggctgggtatggcgcccaggctgtagtttgctgagccctgctcgggagcactccagctcctgtctccaggttttaagcaagccatgcttggtgggataatcagagtcccccctcaacttatcttgcctgtgaccccaggcagaagcctctggacccatggagatacctagaggcatgaaggacgtggtctcactgagactgtgttggactgtctgggtgaagtagcaatggggagctccctgcagccccggcccacagcaaggccccctgagcccgtgggtggtgggtctgagtgtgccttgcagagagggactctctacactgggtgtccacacaacctgtagacatgcctcactcagagaggtgccgggcaaaccatctcccttgtaaccccaacttgcctgggaacgtgcattcaccccagctaaaaagatcctgaggcatctccccagagaggtggacacatgtcagtatcagcgttccatgtgtggtcatgagtccctctcttgttaaacagtggtctccagcactttgggaggccgaggcgggtggatcacctgaggtcaggagttagagaccagcctacccaacatggtgaaatctcatctctactaaaaatacaaaaattagctgggtgtgttggcacatgcccgtaatcccagctacttgggaggctgaggcaggagaattgcttgaacccaggaggcagaggttgcagtgagccgagatcatgccactgcactccagcctgggtgacagagcgagactccatctcacaaaaaaaaaaaaaaaaaaaaaagagacagtgatctcagcttatgccatactctatgcactgggttcttcctgcgtcaggcttttacccctgggccaggcccacattttaaaacattattatttacttgtttattattttattttagagataggatcttgctatgctgcccaggctggactgctgtggctattcacaggttcaattcatgatgctctacagccttgaactcctgggctccagcgatcctcctgtctcagcctgctgagtggctgaactacacgtgtgagtcactgcacctggccatggcccacagttttaaagaccagctagatggttccagaggaactctgtcttctgcttgtaacccgtccctctcttgcctccatccttcatgattctgggattccatgctatgagaagagatctagaaagccgggagctgagttggactcctgtatcatcctcatgcccccaccccaccagctcaatggaaaatgagacctggaactcaggcttgaggccagactgagtgtgagtcttagctctggaggagtcacttaaaatctaagccaacatttccaatgttgcatgtaaaggggataatcatagaactgattaacttatataaaaagtttttatctggccaggcgtggtggctcatgcctgtaatcccagcactttgggaggccgaggcgggcagatcacctaaggtcaggagtttgaggccatcctgggcaacatggtgaaaccccgtctctaccaaaaatacaaaaattagctgggcatggtggcgggtgcctctgatcccagctacttgggaggctaaggcagaagaattgcttgaacctgggaggcggaggttgtagtgaaccgaaatcgcaccacatcactccagcctgggtgacagagcaagactgtctctcaaaaacaaacaaacaaacaaacaaaaaggttttatccatcatgagtgctcaacaaaataatagtatcatgatttccccatcagtcacctgcctggccttccctgttgtcaaatcctttcctttagtctgagtcatttctcaccttgaccattatctggtctccttcccatccatcctcctgctgcatgcagtctatacccaccactcctcatctttgttgctcctagatccagccttgcatgcattcctcctctctaaccctttattgtctcccacactctaaagaacatatgcaagccacatctgtaatttccaattttctagtggctacattatttttaaacagtaaaaacaaatagatgaaatgattttttaatgatatattctatttaacataataaatccccaatattaccaattcaacctataatcaatataaaaattagttactagatagtttaaacttgtttttcttttgtattcacacttcaaaatctggtatgtattttatattcatgtcttggataatttgctcaagtggataatctggtcagccaagtggtcaagagctacatatgccttgtgaagagaccactttggttgaggggatgcaattcagcctccttcccatgacacagcctttgaaggctggctcaggcttggtcccaagtcccatttcttgtgcaccctctctccctgtttctgccatgttaagccaactgcaactgatcaaacacccgagtctcttggttgcttctaaacctttgcccaagctgtttactgccaggacttcctgtccctttgttgtggcctccatctggctgcactgactcggggctccacaactgtctcaaatctcactccttgggcaagacttccccgagctcttcatgcagttattaacttcctccactgtgcaaacagcatgttttcctaactatatttagcttctactgcacagttataaatttatttagcaaagctccctcccctactaatctgcagattctcagtgggcaggatctactcaacccattgatgtgcctgataaacacttggcaattagacagttgaatgaacaaatgaatgaatgtgtaactgaatgaattttcgggttccaaggaccctgacattctgggatcccattaggtggctggggtcaccaccttagagaattgtgattccctaagaagggagaaccagcccagaccttctcgatcatattagtgactggccacatttcctctcctttctgattctctctctcccccacacccttactgcatgacagtgatgagaaaatccacttgatcaaccaaactacaactttcggcctcatccctatccctcccttgccttctgaccagggccacagtcaccctgtgggttcttccttttgagtgtctctcactcccttcctcctccatatctctgagaccagcctccagccctgctggcctgctctgctgccttctggctctttgttgaacccaagaccagggtttatatatgttaaatataaatatatttttccatatgaaatgtaaacatattttaaacattaaatataaatatacatcttagatatggcctgtgttggaatgtgtaatagattgagtatataatgtctattcaatataaaatttatatttatatatgcagtaatgattcaggttgattgtagttaagaaaaacaagctccaaattcgagagaaatatgtaagaagagagacaggaagaaaaaataatgaggcaggtaaatgcaacagacaattcgagacccacaagtgcagagcaggcttcccagacccggataatgtctcctgggctgataggaagccctcaaccccccaagtccttctcagccataaaccgcctgagcacagagccacagggaccgtgttggggctgggcctctcgactttagttcctctcattctgtgcaaaaggaaaaacaattcagaatctacagaggtttagatgtgtgtagatgtggacagagaagtcctggcacggtggttcactgcccaagaagacagtgagtccctggagggatagaagaatatacatcatgctaatatatgtcatcccagtactttgggaggccgaggcgggtggatcacttgaggtcaagagttcgagaccagcctggccaacatggtgaatccccgtctctactaaaaatacagaaattagttggctgtgggggtcgatgcctgtgatcccagatactcgggagacagaggcaggacgaactgcttgaacctgggaggaggaggttgcagtgagctgagatcatgccattgtactccagcctgggggacagagcaagatcccatctcaaagaaaaaagaaaaagaagttgtgagtgctaagttctctctggattttcaggaggccagttctccagtccacagtggcctgggaggacaggggttcctgagggtgaacagagcctgtgcccggtcaggtaggatcgcatgtccctgaggttcagaacccaggagcatggggagggtccagggggttcctgctgcatggagggaagaccctctttccacaggggccccggagagcgagaggaaggaggagggcaggtcagtgagtgtgacggggtcacagtggagagggaagcagaaagaagtgtccccacaacaagacacacacagtgtctacgctgaagctacagagagggcctctccacctgtgtctgccgcaaagcagtggggcgtcttctggcagcccagagtcacctccagatcccacctgcaccatgcttcctgcagggactgcctgtcttcctaatacactgtcttctgaccagagtcttccagacaaatcactggttgctatatatatatatatatatatttttaatagctaatatcttacactgatatatttatattatatataaatatttttgtactttatgtttaggctatattacagatgtagttagttagctatttatgttatatataatataaacatgatgtagattcttatatttctctggggactcactgtcttcttaatacactgtcttctgaccaaattcttccagacaaatcagctgttgctatatatatatatatatgtgctatatatatatgtgctatatatatatgtgctatatattttattgcatagaatatattatatattaattatataatatacattatacattacatattatatataatatattatattattatgctatatcttatatattatatatgttatatatgtatatatattatatatacacatacatacactcatgtatattttaatagctaatatcttacactggtatatttatattacatatgtttatatacaaatatttttgtactttatgtttatgctatatatacagatgtaattagttgtttatgttatatgtaatataaacatgatgtatattcttattttcctgtgaggacccactgtcttcttaatacactgtcttctgaccaatgtcttccacacaaatcagctgttactatatatatatataatatttatatacacatatacacatacatacacacatatgtatattttaatagctaatatcttacactgatatatttatattacatatagttatatactaatatttttgtactttatgtttatactatatatacagatgtcgttaggtatttatgttatatataatatattaacatgatgtatattcttatattcttctggggactcactgtcttcttaatacactgtcttctgaccagaatattccagacaaatcactggttgctatatatatatttttaatagctaatatcttacactgatgtatttatattacatatagttatatacaaatatttttgtacttttgtttatactatatatacagatgtagttagctatttatgttatatataatatatcaacatgatgtatattcttatattcctctggggactcacagtcttcttaatacactgtcttctgaccaaactcttccagacaaatcagctgttgcaatatatatatatatatatatatttattttttaatagctagtatcttacactgtggctcatgcctgtaatcccagcactttgggagaccaaggcaggtggatcacctgaggtcaggagtttgagaccatcctggctaacacagtgaaactgcatctctactaaaaatacaaaaattgattgggtgtggtggtgcatgcctgtaatcccagctactcgggaggctgaggcaggagaatcgcttgaacccaggaggcagacgttgcagtgagccaagatcgtgtcgctgcactccagcctgggcaacagagtgagactccatctcacacacacaaaacatcttacactgatgtatttacattacgtgtagctgtatataaatatttttgtacttacattctgtgtacttatattctatatattataaaacattatataaaattatacatgtataataaaatgttacataaaaattttaatataataccattttactacatatatttctaaatttaatataatgaaattttatatataataatgtataacatttctaaacttattataatacaatgatatataattattttctcatattataattatacataaggtaatttattgtaaataaaattttatataatctacgtttattataataaaattttattacatataacacatttctaaatttaatacaataaaatactatgtataataatttataacatttcaaaatttattatataattttattatacaattattttatacataattatatatagtatataattgtatttatagaaatataattatgcatatacaatatgtaattttatttttacatagtatatatacataattatgtattaacaaatataataatatcaatttatatacttatttacattaagttatatattatataaatgatgttatatgttatatgttacatatatttttgcttaatatattaaatttaatctataaaattatgtattacaaataaaagtgtattttacatatacactacatataactttatttatataaaaatataaaagtcatatggttaagttaataaaatatatttatatcaatctattcatataaaatatacacaatgcatatttatataaatacaaagtatataaaacttttaccagtaggatgcaaagagttgctgaccgtctgcagaaatcctgaacctctggaagcagaataaaatcttacctcccagtctgctttgaaaggaacagtaaagcagtcccgaaccccaaacccatcctaaggggagatgggggagttgggatggacgcgttgaccagtgaggactttcctttgctggttttgaggtgtcttagcccagaagctaagacgggaagtgattctggagcaggtgagctgatcacaagcctgagccaagaatccatggagctcataaatagcagaagccgggaccctgtgcaaatccttctgaaatatcccccgtttactgggctcctaggggtggggaagaaaaattccctgacatttcggcctcagggaaagagagagagaccccactggccggaagcctctgctatttttcagaagacagctggggcatcactctttcccaaatgacggtgattttcagagtggttcactttttggagagacatttctgccctggagatccatacatattgaacccaaacgaatattttttaattaaaaaaaattaaacattagaaagttcaatattgaggcagctacgagtttgaattcctcatttttcctagatgcatgttgtcaaaatctgtattgcatttagtaactacttatgtgtctaatgtatataaggttacacaatgtttttttctgctcctcagggtcagaatttgaaataaaagttttggaaagaaaaaacactcttgtctgtttgtgcaaaaataaaagaacccatattttaagaatattttaaaataaatacaaattttgtgtgggagggttgcttataagaattcttcatatcctaaatcaaagacagatcttgttattaaccagaaaacaaaatgtgtgtgtataaatgtacaacactcttacactcacacaaacacaggcacacacacacattcacgcactcactgatgtactcacacaaacacaggcattcatgtataaatacacacataagcgtgtatttatagaaatataattacacacatacaatatataattttatttttacatagtatatacacatcattatgtattaacaaatataataagatcaattttattatatacttatttacataaagttatatattatataaatgatgttatatggcatgtatatatcacatataactttgcttagtatataaaatttaatctataaaattatgtattacaaataaaagtatattttacatataaactatatataactttatttatatgaactataaaaatcatatgtttataataaaatatatttatttatatcaatatattaatataaagtatacacaatgtatatttatacaaaaatttttaattaaaaaatattcatttgggttcaatatgtatggatcgccagggcagaaacgtctcttcaaaaggtgagccgttctcaaaatcaccgtcacttgggaaagagtgatgccccacctgttttctgagaaacagcagaggccagtggggtgtctctctctttctctgaggccgaaatgtcagggaatttttcttccccaccactaggagctctgtaaaccggggatatttcagaaggatttgcacagggtcccggcttctgttgtaaatgagctccatggattctcggctcaggcttgtgatcagctcacctgctccagaatcactgacacaaatgcaaccacacacttacacaaacacacatcaacaccaagacagacagaagcacaaaacacactcatagaaacacatggacacacaaagacatgcacactcacacaaacgcagggacacacacacaaacacaattacaaaaatgtggggtttttttgcacacgtgggtgcacatgcacattgacatgctcacaaagcacacaaacacgtatacatacaaagacactcataaacagaatcatgaaaacactctcatataaacacgtggatggctactcacccacatagacactcacatatgtcacacgcactcatacacacactcagaatcacacaagcacacacaaacacacaaatacagtcacacactcatgcaaacacagtcacaaaaagactcacataatcatgtggacacacaaacataaaaattcacacactggggccgggcaaggtggctcacgcctgtactcccagaactttgggaggccgaggcgggcagataacttgaggtcgggagttccagaccagcctggccaacatggtgaaaccccgtctctactcaaaaatacaaaaattagccagatgtggtggcgtatacctgtaatcccagctactcaggaggctgaggcaggagaatcatttgaacccgggaggcagaggttgcagtgagccaagatcacgccactgcactccagcctgggcgacagagcgagactccgtatcaaaaaagaaaaattagccagatgtggtggtgggtgcctgtaatcccagttactcaggaggctgaggcagaagaatcttttgaacctgggaggcggaggttgctttgagctgagattgtgcctttgcactccagtatgggtgacagagcgagactccatctcaaaaaaacaaaaaaaaagaatttatacattgccatacagattcacagacatacactcatattcacaaacacacaaatacgataaacgcaggggcacacacaaacaccatcacaaaaacacacttccataaaacacaggaatgcacgctcacacagaaacacgcatggaaacacacgttatcttacagattcacagacacactcatcatcacataaacaggcacacacacacagccacacaagcacacacccacacccacatcaacacacacactcccacacggcacccacgcgctcacgcacataggtagaacaggcctgcattacctgataacgcagttagatcagacgtgatgctgcctgccgaggagacctggaggcttcccatgaatgggctttcggatgagaggtctctgggtgcatttggtgacaccccaggcagtgggggagacgtccaggctggaaggccagccacagccagctctgcccaaggatgccacgtccatttgcttcagtaggatatgcaccctggaaacccaggttcctgcctctccaggaaaccccactgaggtcagcacatcccccaaggtttagaaggggtctctgggtgcatttggtgacaccccaggcagtgggggggacatccagcctggaaggccagccacagccagctctgcccatggatgccacgtccagttgcttcagtaggatctgcatcctgtaaaccctggttcctgcctctccaggacacgccattaaggtaagcacactccccaggtttagaaggggtctctcggtgaaatgtggtgacaccccaggcagaaggggggacgccacagccagttctgcccacggatgtcacgtccatttgcttcagtaggatctgcaccttggaaacccaggttcctgcctctccaggacaccccactgacgttaacacaccctccaggtttacaagcggtctctgggtacatttggtgacaccgcaggcagaggggggacgccacagccagctctgcccgcggatgccgcgtccatttgcttcagtaggatctgcaccctgtaaaccctggttcctccctctctaggacaccccactgaggtcagcagcccccaccccccacccccaggtttgtccagcttcgctgtctggggagagacacagaaagaccacattcggtggaattctggctataaccttttgtagccggcaagaaggatcaccaagctgtcccgttaccttgctggagcgatcactggtttcacgcttggcccccgtgcagttagtgcctgggccaggctcgattcctggagctcaggtgaaatttgggcttggagctcacgcctgcaccatccagaaagcagaaggcagccggcccgggctgtacggttcgtagaatcagagagaacactgcttgccttcatgtctgtaccacaataaatctgccaactgcggtcaaagtctctggattcctgccccctcattttattttgtctattacggagtggaaggagtgagaaagattttgcttcctattttgttttgcaaagcgcttctaagaaaaacaacccgtgttctgaaaacgagattctgagtgtcccctgggcgcgatgaaaacaaactttgggaatccaagggcctgagaggcagagtgaatgtcatttgcatttccctgcgaatgacaaagtcactttttatttattattattattatagattcaggggatccacgggcagctttgtgacctggggatattgtatgatgctgaggtttggggtatgaatcatcccgtcacccaggcactgagcattgtacattcctgaggtatataatgtgtactaaaaataaaatgtatatttatatatgcactaatgattcaacttgattcctcgtaattaagaaaaacaaaccccaaattctagaggagttctagaaatatataagaagagggccaggcgcagtggctcatgcctgtaatcctagcactttgggaggccgaggcagacagatcacctgaggtcaggagttcgagaccagcctggccaacatggtgaaaccccgtctctgctaaaaatacaaaaattagccaggcgtggtggcaagtgcctgtagtcccagctacttgggaggctgaggtagaagaattgcttgaatccaggaggcagaagttgcagggagccgagactgcaccactgcactccagcctgggtcacagagcgagactccatctcaaaaaaaaaaaaaaaaaaaaaaaaaaaaaaaaaaaaagagagagagagaaaacaaacaagcaagaaaatgcaacagaaaaatccgtgacccaaagctctctccagttgctgctttctgccggaaattcaaagaacctcagggtagtttttcaacccttgtacccccgcccctgcttcctgctctattagtcctgagggtctgtggtgccgctccatcatgtccaggtgcaggcaatgtttagctcccacctataagcgagaacatgtggtatttgattttctgttcctggcattaattcactaagcatagtgccctttggcttcatccatgttgatgcaaagggcatgattttattcttgttcatggctctgtagtattccatgatgcggaaggaccacatttgttttatctaattgagaacatgtggtatttgattttctgtttctggcattaattctctaaacataatgcccttcggcttcatccatgttgatgcaaagggcgtgattttattcttgttcatggctgtgtagtattccatgatgtggaaggaccacattttctttatctagtggagaacatgcggtatttgattttctgttcctcgtattgattcactaagcataatgccctctggctgcatccatgtggctgcaaagacatgattttatttttttcatcactgtgtagtattccgtggtgtaggagggccacatttgctttatccagttgagaacatgtagtatttcattttctgttcctggcattaattcactacgcataatgtccttcagctgcatccatgtggctgcaaaggacatgatattattctttttcatggctgtgtagtattccatgatgcagaaagaccacatttgctttatctagtggagaacatgtggtattcgattttcttttcctggcgttaattcactaagcataattcccttcagctgtgtccatgtggctgcaaagatgtgattttattctttttcatggctgtgcagtattccatggcatagaagggccacaattgctttatccagtcaagaacatgtggtatttgattttctgttcttgtgttaattcattaagcataatgccctccagctacatccatgtggctgcaaaggacatgattttattctttttcatggctgtgtagtattcgatgctgtagaagaaccacttttgctttatccggtaccccactgatgggcaactaggttgattccatgactttcctattgtaagtcgtgctgtgatgaaccttacagggctgggcactgtaatcccagcactctggagggccgaggtgggcagatcacctgaggtcaggagttcgagaccagcctggtcaacatggtgaaaccccatctctactaaaaatacaaaaattagccaggcatggtggcgcatgcctgtaatcccagctgctcaggaggctgaggcaggagaatcacttgaaccaggaggcggaggttgcagtgagccgagattgcgactgcactccagcatgggcaatagagcgagactccgtctcaaaaaacaaaaacaaacaaacaaaaaaaaaaaggaagtttaccatgcatgtgtctttttggtagaatgacttcttttcctttgggtagatgcccagtcttggaattgctggcgcaaatggtggagcagtttagattcaggaggtacatgtacaggtttcttacatgggtacgatgtgtgatgctgaggtctggggtatgagtgatcccatcacccaagtagtgagcataataccccacagttggttttttcaactcttgtccttctaccttcctctctccccctaactagaccccagtatctcttcccttctctgtgtctacgtatacacaacatttagctcccacttataagtgagaacacgcagcattctgttaatttacttaagataatggcctccacactgttcacaatagcaaagatgtggaaccaacccaaatgctcatcagtgatagattggataaagaaaatgtagcacatagacactgtggaatactatgcagccatgaaaaaggatgagttcatgtcctttgcagggacatggatgaagctggaaaccctcatgttcagcaaagtgacacaggaacagaaaaccaaacactgcatgttctcactcataagtgggaagtgaacaatgagaacacatcgacccagagaggggaacatcacacactggggcctgttgcaggagggggggactggaggagggacagcattatgagaaatatctaatgtagatgatgggttgataggtgcagcaaaccgctatggcacatgtatatctatgtaacaaccctgcatgttctgcacatataccccagaacttaaagtagaatagaaaaaataaaaaataataaaaataattaaaaaagataatggcctccagctacatccgtgttgctgaaaaaaaaaaacaccaaaaacatgattttgttccttttcagggttgtgtagtattccatggtgtagatgtacggcattttctcgagggtggagggtgggaggagggagaagatcagcaaaaacaacctgtggctgggtgtggcagctcacacctgtattctcagcactttgggaggctgaggtgggtggatcacctgaggtcaggagtttgagatcagcctggccaacatggcaaaactctatctctactaaaagtacaaaaattagacaggcacggtggtgcacgcctgtaatcctggctcctctgtaggttgaggcaggaaaatctcttgaacccaagaggcggacattgcagtgagccgagatcatgccactgccctccagcctgggccacagagtgggactccatctcaaaaaataatcataaaaataataataataacctgctaggcttaggacctaggttgattccattacaaaaaaaaaagaaaaaagaaaaaactaactttttaaaagaaggatctccctgttcaaaaacaaaaccaatgccctgtcaggaaagatgttctgtgtttctggtaaagctggaaggaacctacaggaaggagtcaccccataaaactagtggagcagcattgccttttggggtgagggctgcttctgttaggccaccaggatgagtaccttcctggggagtgtggttcatcctataccatccaggaagcaattcctgcccccaaatcacccgccagcttctgccctgtaagtaaaatccccagcaagcgggcagcaaggagctacttgccttggaaggcagccgaagtctctgtccaccacccagactgtgtcctctgggcaaggccagggcttccaattggatggttttcacattagcggctgctgtttagaatcatcaacattggccaggcgcggtggctcacgcctgtcatctcagcactttgggaagctgaggcgggcggatcacaaggtcagggaccagcctggccaacatggtgaaaccctgtctcaactaaaaaaaaaatacaaaaattagcttggtgtggctgggcatggtggctcatccctgtaatcccagcactttgggaggccgaggcgggcggatcatgaggtcaggagatcaacaccatcctggctaacacggtgaaaccccgtctctactaaaaatacaaaaaattagccaggcacggtggcaggcacctgcagtcccagctactcgtgaggctgaggcaggagaatggcgtgaacctgagaggcagggtttgcagtgagcccagattgcaccactgcactccagcctgggtgatatagagtgagactctgtctcaaaaaaaataaaaaaataaaaaattagcctggtgtggtggtcggcacctgtaatcccagctactcaggaggctgaggcaggagaattgcttggaccccggaggcagaggttgcagtgagccgagatcgcgccattgcactccagcctagacaacagagcaagactctgttgcaaaaaaaaaaaaaaaaaaaaagaatcatcaacattgccttggcccaatctcttgtcaaatatttaccactggacctccatgttctagtttcaaagctctgctggccacagtggctcatgtctgtaatcccagcactttgggaggctgaggtaggaggactgcttgaacccaggagcatgaatccatcctaggcaacatagtgataatagtgtcaaatcagagccagtgtctggtaattccccaaatatctgagaattttcttttctttaagtcatagtcatcctggcagaaggctgtaggtccctttggggaagactgggaaaaagataaacaatgtaaatttttggcaatgtagcagcgtacttccccaagatcacccagcctccccttcacttaaggggttgtgggcctgtgaactggctcaagtctgggaattgattgagggttttagatctgtgtttcattaatttgagttagtcttttattcagttgacctagaattcttcattttttaaagaacaactaagactttggtacagcccattagctctccctgtggataccatggattacacaatgccgtgggtgtctgtgagtcaaaccattctgactgctgctttgacactgctttccactgtggtgaccacacccaccttatcttcggtgattaaggacagcccatgttccctgccaccctaggattcaattatcctcattttacttaaagatcccagtccagtggctgcagttcctgctgtaacattttgcctactgagagcacaagctcaaagctcttccaggatactgggctcctctcacaatattctttctcatgatcgtcgtgaggagtatgttctgtagaccctccagtgtgagtgagcaggtctgacataataaatccagtctccgtgagtttttgcatacctttctgtacacataaaccaaggaagttgtggcatctcaactttatgtaccttaggtaaactctgattctgtttcagccaaccaaccaagtcaccaaacaaataagcaaacagccaaccaatcaaccaacaagcaagcaacaaaccaaccaaacaaccaagcaaggaagcaagcaccaagcaagcaagcaaccaaccaaccaagtaaccgatcaaaccaacccttggagccctttctaaagctttgacttacaaccctgagtccagaatctctgtttagtgggccaacattaataaatgtagccgaatccaactttatgttacttccaccatggtgccactcacttaatatccattcccacgtatattctccagatttccttctgtataaattgcgtgtgtgtgtgtgcgggtgtatgtgtgtagaaagagagcatcaactgaaaaatcacaaaattttataaatttagaaaagagagctttatttcttataaaggtttgcagtccgcaaggtggccattatgacaggctgggaagtgtggcctacagccaaggccagaggcaggcatttccagggagggaaggagaggacaggaatttgagccaaatgagttggctacatatacatactcaataggatatcagaggagctacatcattttatgagaatactcataaaagaggtcctaacgcatgcatattcaataaacatgcatgttcattctggggtggagacttgacatttaaatgtattataattaggccctacacatcaaaaagtgaagcagggacataaaggtactcagcctctgtaaaggctcagcctctgtaaaggcacagcctctaaaactggccagaaccagtccatggaggatggtctcttatcaggagaaagttactgaaatcagtcccttgtccagagaaagctgtcgttaaggttagtggggcaggagatcagttactcagcgtctgtgaactgggtgagttgtaattgttttaatcttgcttctctcacagccagtgcttgcttggctgctagagaaaaataaaacccatgtggtagttagaatctagttaattctttaagagtagggtacaagacttaaccctcgcctggcatggccctaggccctgtttataatttgaggtcttattgccacaaagagtctgttctgtcagtctcatgatctctattttaacattaatgctgctcagttgttgggtctaaaccataagagggagggaggtacagggaggtatgtctgacctcctgtcctgtcatggccgagaactgaattttaagatttatttgaggttccgttggccaacagggggtctgttaagtcgggtggggggcttaggattttattttttgttctcaagggagataaaataatttaatccattggcctctgtgactgtgggactaacatggctatgatctgtcggacagacttcaggctggcacccaggcaaaattctatgctgtagtaaatgcatcatgcacatttgtaacaacacgtacataacaatgtcacaaaatactttcacggtgacaactagattagtgttttattgaatagctgatgacataaactgtctcatttggtgccaagactgaccatcaccagcataccaaggtcatcactgatcagaggtctaacccaaggagggggtcatgtgcaggcccagcggtggggaggaaagatgctgcagaggagatggatgcccacagaggcccctgagcggataccatgctcactaagtggtaagtatagactcaacgtaggctgtaagctctccccctgtgtaaatgggaccccgtacacttgagagtcaagggtctgtttgggtggcagggatagccacttctgaaggtagaaaggaaaataagccaccaaattggtacctttctgtgaaatggacatcgtgctcagaatctccattttccccacaacctggaggagtaagtactgtcatctgcattttgtagctgaggaatctgactcaacaaaattaaattactcgcctaagcaattagcaatcaaccaagtctttctgactcagaaacccagctattgcctgttcatatccagcccctgtattggggtcaagatctggcctgttctcaatgcagcaagatccaggcagatcacactggactcccagcactgaatctggctcgaggggacatcaaatttgactgggtcatggggctcaggagcatcactctcaaaaatagcagtacaggaagaggcaatggccctaaacagcatttgcaggcagatcccatgttaatcgtaagggtcaggactctctcacttttctgtctctctctctgtctctcctctagggctgaccccacatcggacaccactgcatccatgtccatcacaacacagctgccttttcttctgcctgcttatgggaaagtcccctcctctcctccgtttccttctcttcctgccctatcacactgtgcacttctccctttccttaaagaaccaccatcaactttaggaggagggaaaggggtggctctgggaggaaaagccagaatcccctctagccagcagagagagaggaatggctgcatgttttctcccccaatccaaggcactaggttttggctaggttgcaggttccaagctgctctcctgctgtgtcggtgagttctggttaacctgcaacctcctgatgtggccactgcagttcatcgagtcttcagggactccccatggcctggagtactttgccttgcttacatgggagaggagaatggatttatagagaacatcatctaaatccaacttgaccattgtgtggccacacttgctagattgctatagtctaaatctagcattgtagaaagacgggggagcttggagctgcacaaacccaggtctggaacgggctccttaccttggaaggtgaatgatcctggtaggactcttagcctccctgggcctcagtttctttatctgtttcatgggaatgaggatctcggctggttggttgggtgatgcgggggctgtgtgaaaacagcttgtcaatacaagctgaaatagaaatatttctccacagagtatgaagatcaaatgagagaatacatttaaattaaatggaaaattaaaatggcaaaaaaggcaaagctgtattgaaagttccgagcttctctataaggagctttttgactatgtaagaatcctgtactcgttccccctaaatataaaaaaaaaatgttgaaggaggcagaagggagagtgatgcacgatgggcgaggacttcacctgctgttgctggctttgaggatggaggaaggaggccacaaacctagaagctggagcccctagaagctagaaaaggcagggacccgattcatcccttgagcctccagaagggacatagccctgccagcaccttgactttagcccagtgagatcctcttaggacttttggcaaccagaactataagacagaaatggaagccactgagtctgtagctgtttgttgcagcagcaatagaaaactaatgcagagcccaagaaatcactggtgatgagatggggaagtgggctcaggaggtctggatctgtgatgagatggggaaagtgggctcaggaggtctggatctgtgatgagatgggggaagtgggctcaggaggtctggatctgagttggggatctggagtggaaggggaattcatttgttcattgtctatccttttgcattaattgaatttttttctatacatacatgtgaattttcacaataaaagttttttccaaaataaaataaaagaaacaaaaggggctttttgcaacccaattcctatctatgtctgagtccacttgtattgaatgagtctttctgctaacgtccttatatttgggtgactatctgaatgtcagtgaccaatcagagcagaggcagaccttggagtgggcagggcatcctgagggccctgattcctgccataaggcataaccctttaggtgccagaccatggggaggtccaggggttgcaggggagggctgtgcatctgcaatggctctcagggggctcccggtggtggcaattggtgaatctgcatggtggtgtttcagtattgtcacaaccctgctgtctctcatgctctcaaaaagcatttctcttacctgtgacagacttcctatacctaacagcttgcaaaaatgttccagattaatgagaataatctctcggagccatacctccctgcttggggtctcagtttccccaaatgtctccagacaagttaggctagaaggcccctgagtctcagcccctctatagccctcctgtcacccagacctgatctgggtcttgcaccctgggtgcagcatgacaggggtgggcaggggctggctctgggccagaggaccctttctgatggacttcagctgttggccttccaggggagactgatcaacctcacaagagtcatatggtgagtagcggtgggcaaatccatccccctcatcttagatttatggggagacagagacaaagaggagacactccaggaagacctgcaggtgggagtaccaggttgaaaccaaggacaccttcctggaggagctgccgtttgagccagctctgagaacaggtggagacaggactggagaggaggaggttgtgccctatgagcaaagactggccaccaccccatctaacacccccacagggcccctgtggcatccctgtccagtccctgtcaccacccagtttttccctctggacccaggaattcaaagtaagcaaggaggtccgctgctccagttggctgcaaataattacaaccttgagcccaagcagcactttgggtcctggtttgggaccatgaagcggctcggtgagactgagaggtaaggccagggcaggaattgggatagtaggattgaactctccctgggggccagcctcagaaagcctgtggccatggcctcttggccaacatcagatcctgtggtctggcaatgcctggggtacccagacctcactctggacaggccctgggagggggccctggtgagattcctggcagcctcacagccactcttctgtccatagctacaacctgtcatgccagctggaggctccatcccagttggctgggagcataaagtccaggaagatagacatcacccaccacaggggccagtcagggcctgaaccagggcgggcagaggttggctgccttgggatatgggtgggctcagggagtcagacagcaagggactagcctcccatcctactgctgagcagccctgtgactggggagagtcaccttacttctctgggcctcagtttccccctctgtggagtgacactaaatgatctctctggagacggggatcaatagggtactggtgattgaccaggcactcagcacatgcctggagcacacagtgcagggctgtggtggggaggtgggctgagttcctagggagtcacccatgtgtgcctgccgttctgaccagccaccaggccctcagggcagagcccactaccagcagcagctcacaccccaagaccagctcagaggcggcccctacctcagcagcagggacatcacagacactttgagctggcactagggtggcttctccagctcccacggggagaggggtcccagctgagtcccactcacgtggagtctcatgcccatgaaagtgccattcaccactggccaggctcatgaggccgcatgagaggggggtcactggggaggagatatcgggggaacagagagggtggttgaatttttgtataataggcagtgcaagtgtttaccgtttggcaggggaaaggtttgttattattagcaatgctacacttcaatattacactaaaatccagtttctctataacctgggagttgctcttttgttctttcttttcccatcttaattaaaatgagatgcagactctcacggtccacagtcgattaagaaatcttgcacggccatcaggttatgtcttggagagcagagtttcagtaccatcagcctggcaaggagctgggcctgctcctcagagctcccgggactgcgagaattggcatgttcacaaggcaccgtcacagcctctgaaacacgctgtctttaaagatgtttgcaggctggacgcggtggctcactcctgtaatcccagcactttgggaggcagaagcgggtggctcacttgaggtcaggagttcgagaccaacatggcaaaaccccatctctactaaaaatacaaaaaattagccaggtgtggtggcaggtgcctgtaattccagctactcaggaggctgaggtaggagaactgcttgaacccaggaggtggaggttgcaatgagcagagatcacaccactgcactccagtctgggcaacaagagcaaaacttcatctcaaaaaaaaaaaaaaaaaaaaaaaacacaaaacacaaagacatttgcaaggaccatgtcctcacccagaatggtgcctgcctttctacagtttttcaggaaaaggaaacattttctgcttctctcgctgaggttttttttaaccacccattaggaacctatagatttcaggatcgaacactgggattccctcagcactaaaggaggacaattgcaaacagagctgaaagtgcaatgtggaaaggtcaggctgaggaaggttcttagccagtagaccaagggcaggaaggacactgcctcctcagtctcccactagggaacttgtgattcttgtcccctgacctcagaattccttgtcatgtttgttttgtctccaagggaagggtttgaattacagaatttaaggctagagtgggcctcgtgcagttaacattaaccctctctctccttcgctggccaaggtgaagtccggaaacatgtagttctgacgtccactctctcgggggatcaccagttcacccatctcacccggcaagctgggacctagtttggcgacaggcatcttccacccacctgggaggcagggttcaacactctgcctctgaccttgtttccttcttctgccacctgcttaggcagccagaaggggttgtccagccagcacctgggctttggcgctcctcaagcaggtggaggaagtttcaggcacctggctcctcaggtgtctgccatccaggtgctcttcaggcctgcccagcagagctctcttgatccagctagaactggccagaactgactcactcaggaatgtgtagactttggcatcaggggctgctttaatttgcacaatttccaaatacctcttttttcttctttttctgatgagtcatcttcctagactttcattttaaagagatagatagttatcaggttccagagaagacatggtagaacatttatatctcaaagacacagagctgagacttcagttttagatactataatttgcctaaaccaaaaaggaaggtgtaggtaaagttctagtcaagacaggatggccaggaaaaacaccttaaaccaagggatggcttgctttgctgatttaagccaatggcttctttatcataagacttcccagtgatttagtcctccctctcttccagtgcacagagacatacccctccttacaaataaaaatgttctttatagatgtaaatttattttacaaaaatgtttcaaaataaccagatgaaaatcatccttatgccagaaagacttgttttttttttcattactagaaatgaaacagtaagtatttgttgtattgacatacttaggcttagacctgtgtttaacaagaaagcctaataatagcactgtggttagactgtagcctatttttccaaaccatcattttattattaaggaaacgaaggaccaaatacctttcattcatctgatatgatcctttaaaacacattccactaacaagtcccatttggaacagctgaaaatcttttaataaaactttttaaagatgagctcatggcttagtgtaaatttcacaagcttaattaggtcaaatggaaggaactcagatgagtagttgcccaatcagagcccattatttgtaagtcatcagacccctccatgaccttaaaactccactctgacctgattattgcaaacctatatacaaaaaagtgaaaggattaattttcattcatcaacctctcaatcccagattttcaaagaaaaaacctatgtaaggaatacttaccaaaaccagacaggaaaattagagcctgcatactttagagtcaaatttgttccactacagccaggtcgcatacaattacatcatttggttcttcatacactctagaactgactaggacagagtttagcatagaagaactgtaagaaataggttctgaaacatagaaattgcaaagttcaaaaggctatgaaaaaaactaatgtaaatgagagactcccctcactttgttttaaagaaatagacccatcagagaaatgcaaatcaaaaccacaatgagataccatctcacaccagttagaatggtgatcattaaaaagtcaggaaacaacaggtgctagagaggatgtggagaaataggaacacttttacactgttggtgggactgtaaactagttcaaccattgtggaagacagtgtggccattcctcagggatctagaactagaaataccatttgacccagccatcccactactgggtatatacccaaaggattataaatcgtgctgctataaagacacatgcacacgtatgtttattgcggcactattcacaatagcaaagacttggaaccaacccaaatgtccaacaatgatagactggatgaagaaaatgtggcacatatacaccatagaatactatgcatccataaaaaatgatgagttcatgtcctttgtagggacacggatgaagttggaaaccatcattctcagcaaactatggcaaggacaaaaaaacaaacaccgcatgttctcactcataggtgggaattgaacaatgagaacacttggacacaggaaagggaaaatcacacaccaggcctgttgtggggtggggggaggggggagggatagcattaggagatatgcctaatataaatgatgagttaatgggtgcagcacaccaacatggcacatgtatacatatgcaacaaacctgcacattgtgcatgtgtaccctagaatttaaagtataataaaaaaaataaaaaaataaaaaaataaatagatgttctgtaaaaatatacacaatttttacagacaaatacatttataagttgtttttatcttaaaaattggggatatttcatatttataactaattattgaaccttaagttttcttggccatttataggctaataaactaagaatcatgtaaactaagccaaagtagaatagacataaaagtcctaacacttcaacttcctatccttcaagaagtatacctcgcaaagctcatttgagagaggaaaagctttcctccaccctctgttttacagcgctgaggtttctcatcacatttctatgacttatagcttaaatccatgttacatggtcactggcattgttagtgcttctcttttaatactgtagaaattaatcaatttggtggcgtatttaattaattctatcactagaggattgtaaaattacatatatgaatacctcactttagagaccacttaattttttttccaaggggatatttgactatatttcacttgtgtcttatttaatgattttataatttaaaccctaaattataaatctagaatttagagagtatatttccccactggattacatttttggaattattatatgtgcacaaatattacaaaatcactgtagacacctgaaaactatattatcttttaaaagcaatatttacattaaactggtataacaaaattgtttggtgcattttttccagtacattttgtatatattacatgtttaacctttttttattcagcaaataatttttgagtatctactaagtgctaggttctgcattactaattgaatttaaagagtgaaataacagacatggtctcagacaataaaaattaacattaggtcacctatttacatattttaaaatggtaattatgaaaactttgagattttaaactagataacattataataatacacttgatgttgttaatatttgccagtgagcaaaaaagaaaataaaaagatggttttattcaatatacactttaaaattgcagaaaatagtcaagtttctctgctttgcagtttaatgtctatgtgtttttctctgcaacttggcttttgtggagtgaaacaattattcttccagcccaataaaggcagaagagtaacaataaatctaatattttaaatgcttatcaaaagatagtaaacatattatttcagaatactgagttcaataagttgacctacaaaaaaagccaaactgacagtattactgaataaggaaaggcccaaagagacaaaatactttttattttgtaacctcggtatgatacaacttaccctaactataaagaccctaaattaccaagatgggtgcttataatatggagagtaaaaaaagtcatttcacttttagcttttttatttctctcagaataaaaagtgtataaggagtttataaagaagttgatactataagttagtactacaaagacagcacttttcaagaaaagacttttttctctcttacaaatatcatgttagcagtatttgttttctccagaaataatgaggaaataaaaacataagtatgtgggtaattagtgtagtttcttaaagaaatgagttaggcaacaggctaataatgtatacttcgctggcttttgaatgccaacaatcatattctttataaggcacagagaagatttttctgaagaataagtatgtgaacctgaaaagtaatcgccacttggtagtgacaatatggatagggtgaagggcgtcatcaagaagcaatgaaaagatacatttgcagttaaatttgaaaaccatgatgtttaatacatatagtaataaagaatactttctcctatttcaaaattattttagaattaagatagaagctaaaatacctagggataatgatatgactatcaaaaattaaaaattaaaggacattttgagtattataagttaagaatgagaacttattacccaaagaacaggggataattcattatgctccatatccattgaattaaaagacaggcccattacctggataatttgaaagtttaattttatttaaaagtcttgtttcattcatcaagctaaaggattagctcccagaaatattctaggattgcatatccccaactctgtaggaagtatagaaagaatgttataagggccaccatctaaacattattatgtaaataatttagtaccattccatttgcctttgtagatttaaaaatgtaaatggctttctcatattaggaaacatcacttttcaaaacccagataaacatagtatattgcaagagaataattattttctttattaaaaaatactggatgctaagtccaaaagacataaattattttatactaataactactaacattttattcattaaaatataaaggtcaaagattttaaaatgatctttaaatgattaataacatgttgatctttttcttctttctgtaaacctttttgagtcttaacaatactaaactatacaagcaatattaaatagtatataaacggattaaaatattcaaatttactagaatgtggacattggaaagaatgaaaataaacagaagcataaagcagcagatataaaattaagaaagcaactaagagtgtttaaagtacatattcatctgtagtctaatgtctaccataaacaatgactcttctcagtaaaacacaaattgttcatgaagggaaaaagcatgttgtattagagaatattcaacataatttttttagtactaacttgtgcctggagtattattggtttttccattatgaacttatgcacttgataatttttttcataaaaattgtatgtacaactccattcaaaagcagtttttggtgggttttttttttttttttgagatgagttttgctcttttcacccaggctggagtgcaatggtgcgaatttggctcacagcaacctagcaacctttgcctcctaggctcaggtgattctcttgcctcagcctctcgagtggttagaactacaagcatgcaccaccatgcctggctaattttgtgtttttagtagagacatggttttgccatgttgaccaggctggtcttgaactcctgacctgaggtaatccgcccaccttggcctcccaaagtgctgggtatgggcaagagccaccatacctggcctcaaaagcagtttttaaaagcaaacacaatataacaccaaagttgaaaaatctatgctcacccaaggatgccaggtttaataaattatttatagaatactgcatcaaaaataagacaataacccaaaatataccattaaagatgtatccactcctacaactagagataattaatctatctggtagcaaatgatacttcaatcagtttcagcatgtctgaaatctttaaggacaaaagtgataaaacatgacttcattcttcattagactcttagaacacttgaaggaaaataatttctgaagcacaaagaggtaaagaggtgtaatctttcaaaaagatattcagtgttcaaaatccaagagtgcaatatcaggctgggtgcggtggcttatgcctgtaatcccagcactttgggaggccatggtgggtggatcacctgaggtcaggagttcgagtccagccaggcatggactctggctgtactaaaaacacaaaaattagccaggcatggtggtgtgcacctgtagtcctagctacttgtggggctgagacaggagaatcgcttgaacctgggaggtggaggttgcagtgaaccgagatcatgccacctcactccagcatcagtaacagaatgagattccatctcaaaaaaagaaaagagtgtaatatcggtatacacagataatatactgaatgaaacaaatagaataatttgaagaggtatcttgatgaacaaggagtcattagaaaggttgtattcatgtctttgaaggaaattgcaatgtgagaaattaatactttgactactatactaaaagtttattgctaacatgtattgagttattaacgtgtgttaggcagagtgccatataatttacaagtgttatctcatttattgcaggtgaaatgtaatttcgaactctggaagtataaatgaattagatagaaaaaaattctatttaaatggccaccagtaaatcggtatctaggaacagggtgatacagtgcccaagttttctattcttactaaatgttgtgtttcattttcaatgttttcttggatattgctcttttttggtgattttgatttttttttattttagaaaactaataaattgactcttcttggtactgactcgggttttatagaagaaaaagtaaattctgtacatttacctttacctcatctttttctcttttaaatttactatattttttattttttttgtaattttattttatttttctatgattattatttttattattattatactttaagttttagggtacatgtgcacattgtgcaggttagttacatatgtatacatgtgccatgctggtgcgctgcacccactaactcgtcatctagcattaggtatatctcccaatgctatccctcccacctccccccaccccacaacagtccccagagtgtgatattccccttcctgtgtccatgtgatctcattgttcaattcccacctatgagtgagaatatgcagtgtttggttttttgttcttgcgatagtttactgagtatgatgatttccaatttcatccacatccctacaaaggacatgaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttccgatttctccacatcctctctagcacctgttgtttcctgactttttaatgattgccattctaactggtgtgagatggtatctcattgtggttttgatttgcatttctctgatggccagtgatggtgagcattttttcgtgtgttttttggctgcataaatgtcttcttttgagaagtgtctgttcatgtccttcgcccactttttgatggggttgtttttttcttgtaactttgttggagttcattgtagattctggatattagccctttgtcagatgagtaggttgcgaacattttctcccattttgtaggttgcctgttcactctgatggcagtttcttttgctgtgcagaagctctttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtgtaaggtgtaaggaagggatccagtttcagctttctacatatggctagccagttttcccagcaccatttattaaatagggaatcttttccccattgcttgtttttctcaggtttgtcaaagatcagatagttgtagatatgtggcgttatttctgagggctctgttctgttccattgatctatatctctgttttggtaccagtaccatactgttttggttactgtagccttgtagtatagtttgaagtcaggtagtgtgatacctccagctttgttcttttggcttaggattgacttggcgatgtgggctattttttggttccatatgaactttaaagtagttttttccaattctgtgaagaaaggcattggtagcttgagggggatggcattgaatctgtaaattaccttggggagtatggccattttcacgatattgattcttcctacccatgagcatggaatgttcttccatttgtttgtatcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttcgtacattgattttgtatcctgagactttgctgaagttgcttatcagcttaaggagattttgggctgagacgatggggttttctagatatacaatcatgtcatctgcaaagagggacaatttgacttcctcttttcctaattgaataccctttatttccttctcctgcctaactgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgcatattgaaccagccttgcatcccagggatgaagcccacttgatcatggtggataagctttttgatgtgctgctggattcattttgccagtattttattgaggatttttgcatcaatgttcatcaaggatattggtctaaaattctctttttttgttgtgtctctgcctggctttggtatcagaatgatgctggcctcataaaaagagttagggaggattccctctttttctattgattggaatagtttcagaaggaatggtaccagctcctccttctacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcctctttatcattttttattgcgtctatttgattcttctcttttttctttattagtcttgctagcggtctatcaattttgttgatcctttcaaaaaaccagctcctggattcactaattttttgaatggtttttttgtgtctctatttccttcagttctgctctgattttaattatttcttgccttctgctagcttttgaatgtgtttgctcttgcttttctagttcttttaattgtgaggttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagtaggttgttcagtttccatgtagttgaatggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctactaggtccgcttggtgcagagctgagttcaattcctgggtatccttgttgactttctgtctcgttgatctgcctaatgttgacagtggggtgttaaagtctgccattattaatgtgtgggagtctaaagtctctttgtaggtcactcaggacttgctttatgaatcttggtgctcctgtagtgggtgcatatatatttaggatagttagctcttcttgttgaattgatccctttaccattatgtaatggccttctttgtctcttttgatctttgttggtttaaagtctgttttatcatagactaggattgcaacccctgcctttttttgttttccatttgcttggtagatgttcctccatccttttattttgagcctatgtgtgtctctgcatgtgagatgggtttcctgaatatagcacactgatgggtcttgactctttatccaattttccagtctgtgtcttttaattggagcatttagtccatttacatttaaagttaatattgttatgtgtgaatttgatcctgtcattatgatgttagctggttattttgcttgttagttgatgcagtttcttcctagtcttgatggtctttacattttggcatgattttgcagtggctggtactggttgttcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatatgaacgttggcctgccttgctagattggggaagttctcctggataatatcctgcagagtgttttccaacttggttccattctccccatcactttcaggtacaccaatcagacatagatttggtcttttcagatagtcccatatttcttggaggctttgctcattccttttaattctgttttctctaaacttcccttcttgcttcatttcattcgtttcatcttccatcgctgatactctttcttccagttgatcacattagctcctgaggctttgcattcttcacgtagttctggagacttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttctgttgctggtaaggaactgcgttcctttggaggaggagagcgctctgctttttagagtttccagtttttctgttctgttttttccccatgtttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtatcagtgtgcccctgctggggggtgcctcccagttaggctgctctggggtcaggggtcagggacccacttgaggaggcagtctgcccgttctcagatctccagctgcgtgctgggagaacaactgctctcttcaaagctgtcagacagggacatttaagtctgcagagattactgctgtctttttgtctgtgccctgcccccagaggtggagcctacagaggcaggcaggcctccttgagctgtggtgggctccacccagttcgagcttcccggctgctttgtttacctaagcaagcctgggcaatggtgggcgcccctcccccagcctcgctgccgccttgcagtttgatctcagactgctgtgctagcaatcagcgagactccgtgggcgtaggaccctccgagccaggtgcaggatataatctcgtggtgcgccgttttttaagtccatcggaaaagcgcagtattcgggtgggagttacccgattttccaggtgccgtccatcacccctttctttgactcggaaagggaactccctgaccccttgcgcttcccaagtgaggcaattcctcgccctgctttggctcgcgcacggtgcgcgcacccactgacctgtgcccactgtctggcactccctagtgagatgaacccggtacctcagatggaaatgcagaaatcaccgtcttctgtgtcgctcacgctgggagctgtagactggagctgttcctatttggccatcttggctcctcccccttaaatttactttaattgacatataataaatgtacatgttatggggtacagagtgatattttgatatatttatacgatgtgtaaagatcaagtcagagtcattatcatatccattacctaaatcatgtattatttctttgcagtgagaatattcaaaatcttttattttagttatttgaaaacacacaataaattcccattaactacagtcacccaacagtgctgtagagaactagaacttcttccttctctccagctgtaattttgtatgtattaaccacatttttcttatactcttctttctcctactctttccaggatatggtaaccaaaactctactatctacttctacgggattaaaaattttagcttccatacataagtgagaacacgtagttatgtggtgtttatgtttctatgccaggcttatttcacctaacataatgccctccacttgcattcttgttgccacaaataacaggattttgttctttattatgactaaataatattccattatatatgtatgtcacatttctttatccattcatctgttgatggacacttttgttgattccatatcttggctattgtgaatagtactgtaataaacatgggggtgcaggtaactctttgatatactgattttctttcctttggatatatactgaaaaccatatgattaaattaataaacacaataaaagcgtttggcaaaattaaatattcttacatgacaaaaaacctctcaacaatttagtatagaaaatatatgccttaacacagaaggacataaaggacaaatctacagctaagatcatactgagtgtggaaaacgtgaaagattttactgtgaacaagaaaaagattttactggaacaggaaaaggatgcctattctcaccaatcatatttcacatagtgaaagtcttagccaggacaattaggtgagagaaagaaataaaggacatctgaattggaaaggagacagtcaaactgtccctgtttaaagacaatgtgatcttatacacggaaaaaaataagactctaccaaaagcttcttagggtgatacatgaaattaataaagttgcaggatataaatcaacatacaaaaatcagtagcatttctatatattgatagtaaactagctgaaacaagaaattaagaaagcaattccttttacaatagctacaaaaatgtacttagaaataaatttaaccaaggaagtaaaagatttcgacaacaaaaatgacaaatactaatgaaagaaattaaagaaaacacaaaaaaggaaagacatccacgtttatagattgaaataatattcttaaaatgacccactatcctatgtgatttacaaatttagtacaatcactagcttgtatttttaaaagcacctttgctgcatattcttaagatattcaatgacaatgcctggatttaagtttgaggtattattatatctattttatactgggcacaatataatgttatcagaggtaatggttttgattggtcctaggtcatacagtaatatatacattgtgatttatagacatgctatcttttaatactcaggcatttacaaagttcatttagacaaagttataaaaacttgccttcctttccgcctatatcacctaaaaatcctaatttaagaggtaataacattttttgatatacaatttatcaacacaataaaaatctaacaattatcatgtgcagagtgtgaaaatctcatcagattaaggaacacaaagacatctttttcatatttcgaatgtaaaactgttttggaaactgttatttttagaaacagttaaaaacattttttcattagtttttcatgtaaaattgtgacaaccagcatgaaataactgtcatcacagaagcatggtatattcgattccaaaacatattctttgtaagttttaatatatttatgtattatttatacttacattgtaacccataatgtacagatattatttttccttcaactcttaagaatattcttaaataataaaaaattaatgatttataatttttgttggttgggaaaaagaatagacacacacgtgacagtgcatcacttcacctcatcatttcatctcatcattttatctcatcatttcatctcatcattttatctcatcatttcatctcatctcatctcatcccatcatttcatatcatctcatttcatcaaatctcatctcatctcatttccatttcattttcattatttcatttcatcatttcatttcactatttcatttcatttcatctaatttcatttatttcattatgtcatttcatatcatctcatttcatttcatctcatattttttatatcatttttcatatcatttttcatctcatcatttcatctcaattcatttcatctcatcatttcatctcctcatctcatcatttcctcctttcaacatttcatctcatttcttctcatctcatttcaatttcatttcattatttcatctcatttcattatttcacctaatttcattatttcatctcatctcatctcaattcatcatttcatctcatttttcatctcatcatttttcatctcatcatctaatctcatttcacttcatttcatctcatcatttcagctcatcatttcatgtcacatctcatttcatcatttcatttcaacatttcatttcatctcatctttcaatttcatttcaatatcatcatttcttttcatttcatctcatttcattatttcatttcatttcatctcaccatttcatctcatcatttttcatctcatcatctcatctcatcatttcatcatttcatctcatttcttctcatcatttcatctcatcattttatctcatttcatctcatctcatttcaatttcatttcattatttcatttcatttcacttcatttcatctcatcattttatctcatctcatttcatctcatttcttctcatctcatcatttcatcatttcatcttgtttcatctcatttcatctcacctcatctcatcatttcatctcaacatttcatctcttcctttcatttcatctcatcgtttcgtctcatctcatctcatctcacctcagcatttcatcatttcatctcatcatttcttatttcatctcattttatctcatttcatctcatatctcaattcaatttcctttcattatttcatttcatctcattcatttcatctcatttcattacatctcatcatttcctctcatcattacatctcatctcatctcatcatttcatcatttcatctcatcattgcatctcatcatttcaaatccatcattcatctcgtcatttcatctcatcatttccatttcatcatttcatttcatcatttaatttcatcatctcatttaatttcacctcatttcattatttcatttcattttttcatttatgtcatttcatttcatctcattacatttcgtctaatttcatttcatcccatttcatctcatcatttcatctcatcttttcatctcatcatttcatctcatcttttcatctcatcattttatctcatcatctcatcaactcttttcatcttatcatttcatcatttcatctcatctcatatcttctcatctcatttcaatttcatgtcattatttcatttcattatttcatgtcatctcatctcatcatttcatctcatcatttcatcattttatttcatcatctcatcttatcatttcatctcatttcaattttatttcaatttcattatttcatttcatttcatctcatcagttcatctcatcatttcatctcatcatctcatctcatcatttcatctcatcactcatctcatttcatatcatcattttatctcatctcatcatttcatctcatttcatctcatctcatttcatcattacatctcatttcatctcattttatgtcatcatttcatgtcatcatttcatcacatctcatcgtttcatctcatcatttcatcatttcatctcatttcaactcattgcatctcatctcatcatttccatttcattattccatttcatcatttcatttcattatgtcatttcatctcatcatatttcatctcatctcatcatttcatttcatctcatcatttcatctcatcatttcatctcattttatctcatctcatcatttcatcatttcatctcatcatttcttctcatctcatcatttcattatttcatttcatctcatttcattatttcatttgtcatttcatctcattacatttcatctcatcatttcatccatcatttcatttcatcatttcatctcatgatttcatctcatctcatctcgttatcgcatttcatctcattattgcatctcatttcatctcatctcatcatttcatttcatcattacatctcatcatttcaactcatttcaatttcatttcaatttcatcattacatttcataatttcctttcattatttcatttcatttcatctcatttcattatttcatttcatctcatttttcatctcatttcatctcatcatttcatctcatcattcatctcatttcatctcatcattttatctcattatttcatctcatctcatctcatttcaatttcattatttcatatcatttcattatttcatttcatctcatcatttcatctcgtttcatctcatcatttcatccatcatctcatcatttcatctcatttcatctcatctcatctcctttcaatttcttttcaattttgtcatttcgtctcatcatttcatctcatcgtttctactcaccatttcatctcaaaatttcatctcatcatctcatctcatctcatcatttcgtcatttcatctcatctcaagtcatcttatcatttcatctaagtgaaatgatgtaatggaatcatgaaatgaaatggataggatgccctcagtgatgttaaatttaaaaattgtttcttttcatgtatgcatttttatatttatatgtatttatatttatatttacttatatttctttttacttatttttatttatatttttacttatttctttatttatagacaaggtcctgttctgtggcctaggctggaatgcagtggtgcattcacagttcactgcagcctcgagcaaacctcccaccttagcctcccaggtggctgggaccccaggtgcacaccaccacacctggttaatattttattatttgtagagatggagtcttgctattctgcccaggctggtctcaaactcctgggctcaagcaatcctcctgcattggcaacccaaaatgctgggatgacagatatgagccacagtgcccaacctatttatttatttatttatttaataaggacaaggtctcactatgttgcccaggctggtcaactcctggactcaaatgattctccaaacgtggcctctcaaaatgttgggattacaggtatgagccaccatgcctggctaaaaatagtattatatttttgtatcatataattttcaattaggtaatatgaatattctgtacaggaaatacgcccttaattacataggaataaacatttgttacactgagaaaaatctaacagagctaaaaataaaaattaatttggaaaggtcattagatactgacacattcttacgtttatacattctttcatatattcatatattcttttaacagtatcaatggtttggagttatgtgtacaaaaccatgacctatatgtaatacaactaataacaggcacttacaattcaaggcatattatatacaaagctttaacttcttatcaaaatattttgttttttttctttctgttttggcagatactatgaatacaacattcaactcacagacaccatggagcccttactaagcataaagtactgtgaaaggccagggctaggacagaactgagacagggccagggataggacagaaccggggcagggtcatggccagagaaaaaccaggggcagggtcacagccagggacatgagaggaccaaggccagggccagaagcagggcagaaccagggccagggcagggacatggcagggccagggccatggcaggatcagggtcagcagaaggccagggcagggctagggtagcacagggccaaggcagggcagggtcagtgtagagcaaggaacgggccagggtatggcagggcagggacagggaggtccagggccagagtcaggtccagcacatggacagggcagggccagaaacatggcaggaccagaaaggggacagggcaagggcaaggccagagaaggaccatggaaaaaacatggccagggagggtccagggcaagggcaaggccagggcagaaccagagccagggcaggccaaaggcagggccagggcagggcaaggccagggtagggtggggccagggtagggtgagggtagggccagggcgagttcagggccagggcaggactaagatagcacagggccaaggcagggccagggcagggccaaaaggaggggccagggccaagcatggccagtgtcagacctggggattgtcagggccagggtcagggtcaaggctgggccagggacagggccagagcaagggcagggccagggagaaagcagaaccagagaggatccagagcaaggccagggtcagggaagaaccaggaccaggataaggcaaagccaaggccagggcagggcaagaccagggcagggcaagaccagggcagggcaaggccagggtagggccaggccagggtaggagaaggccatgatagggccaaggccaaggcagggcagggctagggtagcacagggcatggccaaaaacagggcagggccatagcagtggcaggactagcaacagggccagggcaagcgctggaccacagcatggtggggacaatacagggccaggacagaggatggcaaggcaggtccagggccatttcatggactcggtaggcctggggtcaggccagggcagggcaaaggcaaggccagggagaaggcaaggccggggccaaggcagtgccagggcagggcaggaccagtgcagggccaacgcagggtgagggcaaggccagggcatggaagggcagggcaggaccaaggggaagggccaggagagggccacggcagggtcacggccagaacaagggtatggctggggtcaggaatatggtaggacgagggctgggcccaggctgggacacgcagggcagagcatggcctgtgcaaggcacggccagagccaggccatagagatgggagggcaacaccaaggcagagtcagggtagatccagggctgagcagagtcagggcaggtccagagtcgaggcagagctagggcccaagcagggccatggtagcaccagggcagaggagggcagggcaatgcaggactgggccatggcagtgcctggtcaactccggggcagggccagaagcaggacagggccagggccaatgctcaggccagggacagggcatgacaggacgtgccagagcagggctgggccaatgttggggcaggacaaatcagaccaggacacctccaagtccagctctggccctgccttggccctggacccttcctggcctgaccttgtccctggccctgccctatccatgccctgtgtgtttgaccactgttttataaccagaatcctacaagaaacttaaattagttctttttgtgcatttttagtagagatggggtttcacaatgttgaccaggctggttccaaactcctgagctcaagccatctgcctgccttggcctcccaaagtgctgggattacaggagtaatctggccaagtatttaacttctttatgcctgtttcctacatttggaaaatggggatgctttaagtacctagcacatagaattattgtgagaatcaatgcctcacatatttacatattgataaaattatactcatagaacactactggaaacaaagacagtattagttaaaatttagtgattactgcaaatattattactattacaaacaacatagtatagacattactactactatagttatcttaaaaatctaaaataaaaattttacataatagcctaatgtaatctctcctgctctgccctggctcagccctagtgctggctctgcccctagtcctactacatccctggccctgacccttccctggtccagccgctgccctggcccttcccatcttcaggccttaccacggccctaccctggtcctgaccctgccctggtctggtcctgaccctggccctaccccacagaaggggtatggcagagccagggaagggccagggcaaataagtgacaggacacatccaaatccaggaaagggccagggctatgacagagccagggcaagtccttggcagggccaggttccaggccagggccaggaaagggtcatggcagggtcactgtatggccaaggtccaggccaaagccaaggcagtggcagggtcagggctgcataagggcaggaccagagccagtgatacggcagggccagggccagggccagggctgtgccaggacagaacaagagcagagcagggcaggaccagagccaggccatagagagagtagggcaaatgccaaggcaaggccagggtagtgccagggctgaggcaaggtcagggaaggtccagggctgagtcaaggctagaaccaagacaggggcaaaggccggggcagatctagggcacaagcagagcaggctagggcagggcaatggcaagaccaggccatggcagggccagcccaggatagaagagggcacaggcagggcagggccagggccacagctggggcaggacaaggaccaggaccggggtccaggccagggcaagggtatggccagggcagaggtaggccagagccagggtctgggcaggaccaaggcaggtctgttgcagggccagggttcagaccagggccagagcagggctgggacagggccagggccagaaccaggaaagggcaatgtcaggacaagggccatggcaggaccagcaacggggctggggccaggacagggtcaggaccagggctgggccagggtatggccttaagtagcgaagggccagggccagggtccatgccagtgccagcgccggtccagggcagacgcagggccatggccaggtctaggacaaggctggggcagggccaaggtctgggtcagggtcagcacaagaccaggacagagccaggggagggacagggccatggtaagaccagattaaatcagggacaagacacctgcaaatccacttcagggccagggtcagggcagggccagttcagggccagggccagggccaagacagggccagggttagggctcccagggtcattggcagggccagggtcagggctgccagggtcattggcagggccagggccatggcaggaccagggtcaggagcaggggtcaatgccaggccaaggccacacataggaccaggtctgtgctagggccagtgtgagggccaaggcggggtcagggcagggccaaagggagggcagggccagggcagggtgatgcaggcccagggtagcacagggttaaggtagggcacgaccaaccagggcaggtctatggctggggccggggcagggccagggccagggcagggccagagccagggcagggccaagacagtggcagctccagggcagggccagggttaggaccacggacatgtccaaggccagtgccagggcaagggcaagggcaggggcagggccaggttcatctaagaaccagggacaaagccaggcccagagatgggccaggacaggtacctggcagggctagggtctgggccagggccacggcagggccagggccacaaccaggtctgtgctatagccaggtccaacacagtgcccaggtaaggctaggtagaaggccaaggtagggccagggcagggtcaaagccaggctagggccaaggcagggccagggctggcaaggcagggccaggaaagcatagggccaaggcagggcagggccaggccagtaccaagacctgggcagggccaggggcagggccaggggcagggccacggccacagcctaggcaggaccaggttcggggcaggagcaaaacaagggtaaggacagtgcaggttcttggcacagccagggtccaggacagtgtcagggcagggccaaggcagggtctgggccttgataagaccagcaacagggctggggctaggccagtgacaggaccagagtcagggcaagggccagagcagtgcaaggccagggtagggccaggcatttcagggtcagggccaggggagaaccagggcaaggtctgaagcagggaagggccagggccaggacaggtccagggcagggccatgacacggccaggggctgcgttagggcaagggcagggccagagcaaggtaagggtcagggccaaggccagggtagggacagggcaagaaatatggcaggaccaggggcaatgccaaggccaaggctgggccagggctgagccagggctgagtcagggcagggcaaggcagggcatggtatggccagtgcaggacaggacaagagccagtccagagagagagcagggctgatgccaagaaagagccaggctagtgccgaggctgaggcagtgtcagagcatgtccagggcagggccggggccagggacagaaccgagccagggcacagccaagacagggtagggcagggaaatagcatggctgggtcagtactgggacagggcagagcagggcaaggcgatggtagcggcagggcagggacaggccaatgcagagccatgtcatgccggggccaggacacctccaagtccacttcaggcccagggctatggcaggacaaagaccagggccaggatcagggccaggtctgtgctagggccagctccagatgagggtctagcgaagactagggtgagggccaaggtaaggccagggcagggtcaaaggcagagtagggccaggtcagggtgatgacacatccagagcacaacagggcagggtgatggcaagaccaggggcagaccactgccagctcagggccaaggaaaggccagtgcagagccaggaaagggtctgggtctgaacaaggcagagcagggccagggccatggcagagtcagggcaggtccttgacaggaccaggttccaggccagggctagggcagcagcaggggcagggcctggataagggcagggccagggatatggcaggaccagggctagggccagggccaggccatagtgagggcagggcaaaagccaaggcagggtcagggcaggtccagggcaggtccagggagcggccagcaccaagcggggccaaggcacaaccagcgcagggtaaggcaggacaatggcaccactgggccatgacagggcaaggtcagcaccaggagagggcagaacaggcaggcccatggtggggccagggcagggatgggccaaagcagggccaggacatgtccaaggccaggtcagggccagaacaggagcaggaccatgaccattggcagggccagtgccatgacaggaccagggtcaggacaaggggcagggccagagccagggccagaaccaaggtcaggccagtgcaggttcagggcagggccagtgccagggcaagaccagggcagggacagggtagcacagggccaagacagggtcaggatgggaccagagcaggacagggccgagagtccaggtaacagtagagcaggtatagggcaaggcagggcagtacagggccagatccatggcaggcgcagggcaaagccaggcccattgccaatgcaccagccctccctacaaggctcctaccacctggccactgctgcagcccgtccatcgctgtaagcctgaaccccaaccctggctgcagccacctgccctcctagtgcggccgctctcctaccgctctggcgcactgcaatctccgtcactgccacccacccgcagcgaggcaagccgtggtgtcgcaggctcaaggtgtctcctcctcctcctggcacggagcagctgggcaggcaaagccagaaaagcctagaggaagatgtgaggggtggaagggttagagcctcaacttgtcatgccagccactgggtggcaggggccagtttcagcaaaggcactcacacccaccctccaaagtccagcctctccttttggcccaagctggccgggaactggggtctggggtgggtgctggagatatcacagcacccagctccccactccacaggaaccattgggcccaccggggctgcactcctcggggagcaggagaagcagaaaaattcagacccagccagccctccgcacccaggtgccaattcctgttccggacgcctccacgcacagggccctgtcccccatggtgtccccaggggtgcctggcagcctctgaggcacagacccagagtgcacaggcccaggaaccacggtgggtgtgggggctctgccatgctcaggattcccacgcaaacgctgtgtgccctgccgcattccagtatgaccaagagtgggtcgccctctggagtgtggagtcagggagaggagaaccactccttccttggatgccaactctgttgaccgccgccagcagtgcagcccctgatagcaccgaactcgcccccgctccacggctagtcctgccctcaatagcgccccccacctccgtcccccaatgccgccagtagcgtatacccgataatgccctaacctgtcctcctccatgggcactgaagccccagaaagcgcccataacccaccctccctgctgtgggcagtgcagccctgtacagtgctaccaaccagtacccctaatgcaggcaatgacaccctggatagcgcccccaacccaccccacactgcgaaaggtgcagccctggatagcccctgtcctaccactctgttcatgctgcagtctctgtcaccaccaccagcaaccacagtgaggcaagccagtgggccgcaggctctagcatccagcagccaggcatggagcagctctcgctgatggccggctcctaccactctgaccatgctgctgtctgtctccatggccatcttctttcactacaaaggaataaaactaggtatcaataagaaaagtaattttggaaacaatacaatcacatggaagttaaacactaccctcctgaataaatgactagcaggtcaatgaagatactaagacagaaattcaaaaatttcatgaaacaaagggtaatgaaaacacagtataccaaaacttgttacgcagaaagccatacaaaggcagagatttacagctacaagtgcctaccatccaaacaaaagaaaaacttcaaataaacaatacatcttaaagaactagtaaagaacaaactaaaccgaaaataagaaaataaataagatcgtagcagaaacaaaattgaaataaaaaacacacaagattaaacgaaaagttggttttctggaaagctaaacaaaattgacaaacttttaaccaggctaagaaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttaaacaatgaaaacatccaagaccagaacagattggtaacaagtaatgagattgaagccatcagaaaaagtctcccagtaaagaaaagcccaggaactgatgtcttcactgctgatggcttcacaccaaacaatttaaagacctagtacgaatcctgctcaaactattttgaaaaacaggagggaatacttccaaacttattctatgagaccattattactgtgataacaaaatcagacaaaagcatcaaagaaggaaactacaggccaggatctctaatattgatgcaaaaatcctcaacaaaataccagtgaatcaaattcagtaatacattaaagagataattcatcatgatcaagtgggatgtatccctgggatgcaagggtcactcaacatacaatgtgatacatcatatcaaccaaataaacgacaaaaacagtatgatcacgtcaactgaaaccgaaaaagcatttgatgaaattcaacatcccttcatgctataaatcctcaaagaaacgggcacagaagaaacataccgcaacataataaaaactacaggaaagacacccacagctagaatcatatggaatggggaaaaacggaaagcttttcctctaagatctggaacatgataaggatgccccctgtcaccactgttgtttaacatagtaccagaaatcctagctaaagcaatcagtacagcccctgatatggcccccaacccaccctgccccctaccaccagcagtgtcgcccccccgcaacagcacacccaacatacccaagccgccccgcctccccgcaccatgggcattacagcaccccatagcgccctcaacccgaaaccgccacccacccccccaccgcccacagccgcacagtgcagccccggatagcacacttagcccacctcactgttgccagcaatacagtctgggatagtgcccccaaccggctccccgccaaaggcagtgcagccccggtttgggcccccaaaccatccccccgtgcaggcagcacagccccagatagcacacccaaccagccacccaagacgggcagtgacgcctgagatagggctcccaaccggtcccaggccacccgcagtgcagcctggatagcgcgcttaccccaacgcctttctacgctctggctggctgcagtgtccatcgctgccaccaaccacaaacagggctgcaaacaggaaggattttattcaccgtcgatgcggccccgaggtgtcccaaagcgaggcagtgcccccaaggtctgtgcagagcagaacgcagctccgccctcgcggtgccaccggcccgcccgcccgggtctgtgctgaggagaacattgctctgccttcgctgtatctccgaagtctgtgcaaaggagaactcagctccgccctcgcaaaggcacacagcgccggcgtggcggagaggcggacagcggcggagaggcggacagcggcggagaggcggacagcggcggcgcggcggagaggcggacagcggcggagaggcgcacagcggcggcgcaggcgcggagaggcgcacagcggcggcgcaggcgcggagaggggcacagcggcggcgcaggcgcggagaggcgcacagcgcggcacagcgaggcgccggcccagactccactccccagctgtgaaagggtaagaactgagggtggctgagactcggggttgttcagggcggggtgggctctggacccagcaggcccggcacccaggtcagggctccaggggaggccaggtgggcgaaggccaagaaggggccggggctggtcaggaagggctcctggtaaccagagcactttgcgtgagccagcgtgggaggaaggtgggctggatgagctagggaggcgccgggaggggccttggcagaggcgaccccctccgtcagcccccaggccactgaaccctgggtagcgagaaccgacaggggaggctgcatacagaggagtggaggctccccggctttgggggctctgagtagaagcatctagggggtccctcaagaggcccccaaacgcctccccatggtgagaaaagaaagcgcagagaggggcacggctgtgatttcttttattgccccaaatgtacttcatcttggtagatttctattggctttaaaaatgtgtgtgttttgctgttggggagtggggtgttatacggatgtcagattttgctggttgactgttcagatcttttgtaaatccttgctccttttctgcctagtttcactctgtcacttacattagagtgcggtggcacgaacatgactcactgcagccttgacttcctagggtcaagtacttcccctggcttaacctcctgagtagctggtactataggtgtgtgccgccacacctggctaaatttaaaattttttggagagatgaggccttgctatgttgcccaggctcgaactcctggcctcgagctatcctttgtctttgcctcccagagttctgggattacaggcatgagccactgtgcccggcctctgcctagttttaacagttgctaagaggaggatgttgaagtagatgtcttcttggtgggttaatccttttgtcattaagcagttgttatggtcacttccttttcaccccattggtgaaggaggggtccctgccctaaagtgtaggagatggctgaacacgacacctggcgtggatggatgagattgacagcagtgttttagtcacatatacccacagctcagaggaggacactgcatgccacacagggtcagatgggcaccgcactctgtagcggagtgagggctgtgggctgaggaagcaggcaggcttgatagtaacaagagcacacaatgaccaatggttcccgagggggaatgcagttggcttgtttgaataaattcatgggctggcagacaggtgaagtgaagcttcttaggctgaggtgcaactgtttggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcagcgaagaccctctccagctctggtaaattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttatagttacataattgcttatgtctgatgtttttattatttgctttttcgtttcctttttctttccctccatcttgatctatttctgtataatgttgttgctcgtatctctttgtatagtcttaaagtgtttgctctggatgttacaatatgtgtattgtaatacagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctggtctttcctttgtccctcctcctatagtcccatattcatcccttctgcataagaactttctgtagccatttttttgttttgatttttttgttttaattttttgtattgtggaaatgacagaacatatttctgtagccactttttagcatttctaaattgaccagtgacaaattcctatattctcttcctctgagaatgtctttatttctctcttcatttctgaagggtagtttcatgggatatagaatttgcagcgaacagtttttttgtttggttggtttttttgtttggttgttttttttttaaacacttgaaaatgttgtgccacttccttctggcctccatggcatttgagttggcgtgtccctacaggcattctgccatttttggtctttgtttttagttttgaaagtttaattggtgttgctttcttttggtatactttgaggtttgctcagcttcttgaatctgtaagtttatatctttcaccaaatgtgggaagcctcaggaattagttatttgcatgctttcacagctctggtctcctatgggactcagataacataaatgcggggttatcgtcccacaggtccgtgcagctctgttcatttgttttcaggttattttctctctcttgtttagactgggtgaattctgttgatcaggtttcagcttctctgattctctcctctgtcgtctccacttttactcaatagggcccatccagttagtttttttaaaatttctgttactggattttatatttctgtaatttccatttgattcttcagtttctttgctgatgttttcagttctttgattgttgccataggatttgtagttgcttgttgaagcatttttatactgactgttataagtgatgagtcagatggttccaacatctgcctatgtaatttttttatttttgcaggcagtcctcctgtttaggtttagtctgtaggtcttggtctactttgtgggctgtgattccaatggcaatttaatttcagagccttcatggtgttattttggtctctttggcttatatgtatcactgggattctcccaccagtccctgttgttgcccacctgagggaacaggggagccgccctaggctgggccacctgctgcagctaggtgggtggggaatggtggttgtcttggtgtgtggagctggttttcttgttgtggggaagatctcctttgatctgcggggactgagtctgcctgggttgccttctattgctacgttgggagttgggaaactctgggcctgggtcaccttcctattggatgaggtccagggagacacctggccactatgcattccctagtcctagagtccctcagcagcctttttctgtccaccttttggaattctccattgatcctctcctgtctattatttctagagtttgggttacatttcttaggagggtataatgtgttatcttctctagaccagaaatccttagtggtggtttcgggttgtaactgtgctaaagggagaattggcgtatttgtgatgtcgggtctttcttttcaaatgaggacatatcattattcagtatataatatttacaacacctacttccttgggttgaagaatgtggttaaggcaaggaaagtacttaacacagtgcctggtgtggagagcacttacgagtgttggtagtgatgctattccttttgtcctttggtagcctattaaagcttttcttcttttttaaaaaaataaagttccggtgcacttcttgttaggtttattcctattttatccttttttgcttttattgcaaataggagcttcctatcttttataacgtctacctggttctttggcccttacgtgaaaatgttttaatagccttctaaacattgttctctcaaatgagttttaatttgcctctttcttttgttttcctttttttgagacagggtctcactctgtcacccaggctggagttcagtgacgcaattatggctcactgcaacctctgcctcctgggcccccaaagtgctgggtttacaggtgtgggccactgcacccagccttacttgtctgtttcttttaagagtgggaactataattgagcccagagctccaaaaacaaatgaagaaatgaatgagtgaataagctcttcccatgggtttggtgtggtttgggactctactcttaatctaaatgctatgttttatataatctaaaatttcccctaggtgtgttacacgattgtgttgtgttgaacttacattgagactccttttcacatgtgctggttatcagcgtgggacttttccattcactctttgaattattcgtttgggggacacagatagacctctgtgtctttcataaagagtgtccattggccggttgcagtgtctcatgcctgtaatcccagcactttgggaggctgaggagggcagatcacgaggtcaggagttcgagaccagcctggccaatatggtgaaatcccatctctactaaaaatacaaaaattagccaggcctggtggcgggtgcctataatcccagctgctcgggagactgaggcagtagaattgcttgaacctgggaggcagaggttgcagtgagctgagatcgtgccactgcactccagcttgagtgacagagtgagactccgtctccaaaaaaaaaaaaaacaaaaacaaaagagtgtccattatctatactagaaaaattgagattgggattttgacatgaagtgcggaaatgtggattgggtccatttagtttacctaaacagatgatgaaatactaactgttttacgaagcattccctagtgcaaagttttgcctgtgtttctagtgatgggaacagtgagaatcagacttggaacacggagcgcattgtgggcctgtcgtgggtggggccagcagcacatgcatgccgggctgacagagcagcctttgggtgttcttttcccagaggagctctacggtgactttgaagacttggaaacaggggacgtgcacaagggaaaatcgggccccgatactcaggtatgactttgtcgtagctggctgttcttggtcattgtgttctgagagaggcccgcattgagaaatgcaaatcttacttgtgatgtgtgaagattgcagactggatggatagattccttcctaaagtgtggggatgtggggaccaaagagaagctttcttatttacttgttaagttttggactacagttactaccgtttcttgccatagtcatttgccaagtccactgtgatttttcactcacagaagtcttagcttctcagacttacattcaaccattgccatcattctcctctttttaaatttaagtgtcatttaaaagaatgaaatccctgttctccctaatatttctttagaacagggtctgggagcatctgggtgagggacatgtctgttatttttattctagtttgtgttcccagccagcttaaggaatagcagctagttgtaatgcagatgtaacaatttcctgtagcagtaccatgttattcagagacaaaggttatgttgtgttttgttttgttttattgataatgataacagatttttgctaagatttttgtttaaatagaactttaaaaaatctaatgtttaaagaaaagaccttcataaacatacacaaaattttttcttctggaaatttaagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtgagaaacctcagttcctctcagccccttgtcaagactatcacatagtgtaggaatccctgactttctttgggtccctgcttcctatcctgcttctgtgcctttcacttggactcctgggtagatgcatgtgagtgtgtttattcatgcagtgagctcattgtttctacagtcagaaggtcaccagaaaaagatccatacctattttgtaacaagaattaggaaaccgaaatgactgagacatggtctctacttttgagacttttacaatgtagcgatctgagatagtgtgttcatttcagtgcaagccaatgctgcctattccgatcgctgctccctgatttgaatggcaggtgatcagtggcccgtgtggcttatggacacaccagagctcccaggggaagtgctctgaaaacatcctggtcagagttcagaaggacatgtggagtataaggtcagatgcggagataagggagatggtgtggccctcctgcccaggggtgctgagcaggttgctggaggcggtgatctcactctgaaggagacagacacagaaacgtatgtacagttgatggtgagcatctgagttgcgtcttgttagtgaggccaggagtgcctgtgtaagctggaacagattaggtatatgatttgtgaaacggagtttcatcctacgtcttcatctagtcaaaggactgtttcctgattaggcattagcttagtggttgctagtctgtgttgacctttgaaaggcatgactaggctaactctgaagttgttgcttcacaccatttacaatttaaaattacctagagccttgtgggccattggaaaagactgaatgtttcactctgaaatgggagtccttggagggttttgaccagagaagagacattcaggtaatcagatcactctgccaagagatcagtccagtggcacaaaccagagggctggcagtggagatgagacagagtcaaacccggattgagtttatttggaagctgggtcagtaggatttcctggtggactgaatgtggggtgtgtaagaggaaatgagggtggcgactggaagttcctggaagggtgggttgttgcaggttagataggaaaccgtctgcagatgcagttttgggaagatgatgtttggttcggctgggtatcatgcagacaagcggagtgtcaagtctggagagacaggtctggccagggacttagatgtacagccctcagcatgtagatgccacttaactctgtgaggtggccggggagtgagtgcagagtgactgggaggagcaagactggcatgggcgagatggggcgattgcggccgtgaggcctgagcagtgcctaggagggagagggagaagcagtgtgagcatgcaggcacgcaggagtccagttgtacacggaggcgaagcactgttcagatcccgctgcagtgttaactacggtaaaggcagagttgaccactggaggagtccttcagcgtggaggccttcagcgatcttggcaagcaccaattttcgtggatgtaggagaatgggagcagaggaactggaggctgcaactgcggaaaacttttgtggggttttgctgcagagagaagcagagaaatgaagcagttgttggtggaagaaatggaatcaaaaggttttgagatagagaacagagggaagagctgttggaataaagtccaggaagagtggatggtgtctagtgagcaagtgatgtgtggccctgagtagaggcacgtacaaatcacctgtgcctgagctgcccttagaactttctgtgatcatggagatgcacgtctgtgcttcccaatattgtaacattggccgcaggttgatatggaccacttccagtgtgactagtgtgattgaggaactgcattttaaatattatgtaattgtaattaattttaatttaaatagccacacgtagctcctctataggccaggtcagagctctgataaggctggatatgggaggaaaccctggtagagggttgactgtagaggttcttttggttttggagtgaatcaggaaacagccatcagctgagtgaaggtgagggtggtggtgggtgtttgaagacaagggaaaagtgtgaaagaattgtttggagaggaaggaaagaagatgtggactggggatgtttccaatgttcgagcacgcagggctccacagttatctacatttgctgtcccttggagcaggagagaagaaaacggttgggacatattctgagcagactgtagaggtaaaatacgtagtttttttttgttttttgagatggaatctcgctctattgcccaggctggagtgcagtggcacgatcttgactcactgcaacctccatctcccaggttcaagcgattctctcacctctgcctcctgagtagttgggactacaggcacgcaccaccacacccagctgattttggtatttttagtagagccagggtttcaccatgttggcgaggctggtttcaaactcctgacctcatgtgatctgcccgccttggcctcccaaagtgctgggattacaggcatgagccactgtacctggccaaatatgtagtatttttaataggataaagcctacataattctgtccacagttcctttacttagaaattgctcatttgttcatgttaatgctatgtttattacagataacagcatacaggttttccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtcttaagtagtgttcagggcagggtgttaccattcatgcttgacttctagccagtgtgacgagaggctggagtcaggtctccggagagttgagcagctccagccttagatctcccagtcttatgcggtatgcccattcgccttgtgtctgcagccccctggccacacccagtaacagttctgtgatctatgagaatagttcccttagcgacctttcccttcaaatactttgcagccaggtagagaagtttggagtgaaggttttgttctttgtttcttcgcaatatggatatgaatcttcttttgaaaatattaaagtaaattacctcttttcagatattgtcttcatgcaaacttggtatcctgtttccatcccagccttctgtaacccagtaacatctttgttgaaaccagtgggtgagaaagacacctggtcaggaacgcggaccacgggccaactcaggcttgcccatggtgtcagactaaaggcaaacaaggactctctgtataaggtactggtcgtgtgtgtgttagtggagatgaagcctgtgctctacagacagggagtcacacagacacttttctataatttcttacgtactttgaatgttcaagtataaagtctaacattaaatttgattgaacaattgtatgtttgtgggatattttggagtggaacaccaaaaaatggtaatagtggttctttctggattgaagacaaacttttcttttttaaaataaattttattttatatatttgaggttgacaacatgatcttaaaggatacatatagatagtaaactggttactatagtgaagcagattaacatagctaccatctcacatagttagatttttgtttgtgtgacaggaacagctaaaatctacttatttaacaaaaatcccaaagacaatatatttttattaactatagccctcatgatgtacactagatctctaacttgttcatcctacatgtctgctactttgtattattttaatgtacatctccccatttcctattggtcatttcctatttggcccatttttcaactgggttgtttttctgctattaagttgtaagagttctttactgatttttggatattaacactttatcacatatgtggtttgcaaatatttcttccagtctgttggttcccctttcattttgttggttgttcctttgctgtgcagaggctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccaattttattcttttgcatgcgaaaatcctattattgaagagactatcttttttaccattgtgttgtcttgtttgcccttgtcaaaaattagttgacagtatatgtttggatttatttcaaaggtctctgttctgttccattggtctatttttttgtttttatgccagcaccatactgttttgattactatagctttgtaatacaattttaaatcaagaggtgtgatgcctccaactttttctttcacagtaatccgttggctgtttgggattttttgtggttccataagagtttcaggattgttttttcttttcttttttttttttttgaggcgaagtctcactctgtcgcccaagctggagtgcagtggcataatctcggctcacggaaacctctgcctcctggattcaagcaattcttctgcctcagcctcccaggtagctgggactacaggcacatgccactatgcccggccaatttttgtagttttagtagagacagggtttcactctgttggccgggctggtctccaactcctgacctcgtgatccacccgctgcggtctcccaaagtgctggaattacaggcgtgagccactgtgcctggccaggattgttttattcggttctgtgaagaatgccatcagaactttgatgaggattgtgttaaatctgtatatttgctttgggtagcatgaacattttaacaatattaattctcctgatccataaacacgggatgtcttttcattcgttcatgtctaaatttctttcatcaatgttttatggttttcaagtgtacacatctctcaccttcttggttaaatttattcctaagtttttgtttttctttgatgctatcgtaaatgagattattttcttgattgcttcgtcagctacgttatttgtatatagaaatgcaactgatttttatatgttgagtttataccttgcagcttaactgaattgatttagtagttctcacagttttttgtggaatctttggagtttttttacgtaaaggatcttgtcatctgcaaatagagataattttacttatttaatttagttgcctttttttcctcatctgattgctcttgcaagtattctattgaataaaagtgatgaggctggccatccctatcttgtactcaatcttagtggaaaagctttagttgttccccactaactatgattagactgtgggtttttcataaatggtctttattgtgttgaggaactttccttctatacataaactattaagagttttatcaagaaacgttgctgaactttgttaaatgcttttactgcatcaattgaggtgaccatatcgttttatctttcattttgttaatgtgatatatcacattgattgatttacatattttaaatcagccttgcatgccagggataaatcccacttaaacacgatgtataatgtttttgatatgttgttgaattctatttgctaaaatttttttaggatgtttgcatcagtgtttaatttattggagaagttgacctgtagtttttgtttgtttggtgtgtgtgtgtgtgtgtgtgtgtgtgtgtgtgtgttttggtttggcttaggtattaaggtgatactggcctggtaaaatgtgtttggaattatttcctctcgctctgttttttcgaagagtttaagaagtaaactcccaggggatgggagtgactctggacatgggagtgacatgatagtgactctggaccctgcagtggtgggacacagcagcatctctgtctctgtgaggccaggcgcagcatcagcaaggaccccagaatggtggagcactactgtggcttgggccctcgggggcagggaccagtgcagcaactacttctctccctggggaggcaggtgcctgggcaactcagattctccagagctagtccagttccaaggaagcagggttctacagttgtttgtcctgaagggcaaggtaccccagttcagccaatgccgttttcctgggatatgggggtgccatgttggctcatccctggcaggtgtggctgctcagctcagccaagacactgattccctgtgaagcagggcagcgcttcagctctcatgcagtggggggtgtgactgctcagactggccaaggcactgattccctggaaagcagggcaccaagtcagctcaggctccaaggggcagggcgcaatggcagctgggaggggaggggcacagcagcatggccctgcaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcatacacctgtttccccttccactttccctatgagatgaagcagcacaagaccctcgccagttgtgctgcccaatctcggacttttcagacacaagcagggtgagccaaataaaccttttttataaaataagttaccccgagtctcaagtattctgttacagccacactaaatggcctaagacagtgtaacagcggctcgggggtggtgggccactaggtgggtgtgatatagagcaacaaagcctgaggatggaagaagggtgcggtggcagctcaccctgggtgggacatgctcccgaagtggtccaggtccaggagggcacgttgcagcagcagctggtccatgggggtggggcacaatgtcagttccttctctgaggggagtgctggggctactgggcccctcttgcttccttatccctgcagggagacatcccctctgcttcaggctgatccctctgggggaatgggtggtgggggccagatgtttccttccctcctttatgtgaccgtcctggttttctgtgctctgctggatttctgctactccttgatgcactctggggctctcttttagtgactttcatcaaaatatagatgtttgctgctttggctgtctttgtcaggggatgagtgcaaggggctattgatcagccccttgctggcatcactccctcttaaacttttcactgggtactcttttgaactattttttcccccaccgtatacatgtattttttaaacgttaatgtgctaatttctactgaagcaatgtggatttttctgaaagttttaatgttttaataagctttttattgaaatgttaatgtccacacagaagagtgcccgaatcataagtgtgcatctagatgaactgtagcacaccaggctgccacgccctggaccaagcagtagcctcgccctgtggcctctcccaggcactgctgccccaacccacagaatagctactttcccagttcctgatgtagatttgttctgcctggttttgacttctataaaatacagcacattctgtttagcctggcttctttggttcagtattacagaacacatccatgttcttgtctatggcagacattgatttatcgtcattgttgagttccattatatgactgtgtcaccatttttccattgatgagtaaaatgatttcctatttttggctgttatcccacggccctgaacactaggtctggatatgggacttgcaggtatgcaggggcacacgcacttctgctggaggatccctgggtggggtggagactccagggcacctgtgctctgcttcagtatggagtagttggagtgtattgcttagaacaaaagagatgagacactaacactgtgtgtatattctaaatcatatatcagtgaagaaatgtgatgtttgcaacatcttctctggggatgctaaccccctaagtcattattaccatgcatgtaagcacctcacctagatctgcactccatctagcagtgagaaattccaccataatctacacaccataatatcatcaatgtgtctagaagtcagatcctctatgtgtgaaccaagacaatgcctggcaaacaagacagctgggctctcaggtctctgcaccatggggaggtgtgtaaggccattcttgaattactataaagaaatctctgagactggatgatttacaaagaaatttacaaagaaatgttgaattgactcacagttctgtgggctgtacaggaagcttggtgctggcatctgctccttttctgggatgcctcaaggagtttttactcacggcagaagatgaagtaggagcaggcatctcacatggcagaacaggagcaggatagagagtgggtaggaaaggtgtcacaaatttgaacaaccaaatcccatgaaaactcactatcataaggtgaaaaccaacccaagaaggatactctctcatgacccaagtacctcccacaaggtcccacttccaaccttgtgaattacatttcaacatgagatttagtttagcatccaaactataccattattcccctggtctctaaagtctcatgttcttctcacatggcaaaatacaataatgtcttcctaacaatccccaaaactcttaactcattccagcatcaactcagtcgaagtccacagttcagagtctcatttgagttaaggcaagtccctttcacctataggccagtaaaataaaaaacaagttatttacttccaaaatacactggtagtacagacattgggtaaatattcccattccaagagagaaaaaactgccataaaaaaagggctacagatgtcatggaagtttgaaaccccgcagggcattcattaaatgttaaagctccaaaataatctttttttgactccgtctcccacatccagggcacactgatgtaaagggcaagctaccaaggctgagggcagttctacccatttggctacgcagggttcggcccctgtggctactctcataggctgttaagtgcctgcagcttttccaggtgtaggatacaatctgccagtagatctaccattctggaatacagaggacagtgacctccttcccacacctccactaggcagtgccccagtggggactcggtctggggcctccaaccccacatttcccctccacactgacctagtagaggttctgtgggagggttctgcccccacaacaggcttctgccttagcacccaggcttttccatacatcctctgaaatctaggtggaggttgttgaggctccagcactcttgcattctgtactcctgcaggtttaacaccacatggaagcttccaaggcttaacatggcttttgctccccaaaactgtggcatagcattatctggagcctcttgagccaaggctggagctgaatcagccatgaggttgcacaggactgtggggccctaggccagacccagcaagccattcagttcacctaggcctcaggacctgtaatgtgagaggctgcctcagagatatctgaaatgcctttgaggtctttttcccattgtcttggctatcaacacttggctcctctttagttacgcaaatacctctagcaagtgattgtttcgcagcccacttggattcttttcaggaagaggggatgttattttctgccacatagtcaagctgaaaatttttcaatcttctatgctctgctttccttttaaatataaattccaaattaaagtcatttctttgatctcacatctgagtataggctgtagacacagccaggccacctcttgaactctttctgcctagaaatttcttctgccagatactctaaatgattgttctgaagttccaacttccacagattcctagaacatgaatagaattcagccaaactctttcctaaggcataacatgggagatacttgccccagttcccaataagttactcactttccgtctgagatgttgacagcctatgcttcattgttcctaacaccatcagcattttgatcacaaccatttaaccagtctctataaagtctgaagcattttctaatcttcctgttgtgaacccccaaaattggacacaagtctcagttaactcagaaagcttattttgccaaggttgaggaggcacatctgtgacacagcctcaggagatcctgatgacatgtgtccaagatggtaggggtacagcttggttttatgcattttaggcagacatgagacatcaatcaacatgtgtaagatgtacatcagttcagtctggaaaggtggaacagctccaggtgaaggcaggacaacttgaagtggggaaggggcttccagtcttagatagataagagacacatggttgcattcttttgagcttctgatgagcctctccaaaaggaggcaatcagatatgtgtttctctcagtgagcagaggggagactttcaatagactgggaggcaggtttgctctaagcagttcccaggttgagtggggtcccaagatttgttttcctttcacactgtcttctcctgagccccccaaacccttccaacctctggccatgactgagttccacagctgcttttgtactatcaggtatcttttagccatactttatttaccaattatctgtgttaggacattgttgcattgctacaaagaaatttgttgggaaatttacaaacaaaagaggttgaattggcttatggttctgcaggctgtacaagagtcatggtgcctccatttgcttggcttctgaggacacctcaaggggattttacttggtggaacatgaagtgggagcagacatctctcatggcagggtgggagcaagaaagagagtaaggcaggaggttccacacatctaaacaatcagatcttgcaagaactcactcactgtcatgaggacagcaccaagcctcgcggaatccgcttcaatgacccaaccacctcccaccaggtgccacatgcaacattggggattacgtttcaacaggagattgagagaggacacacatccacactatatcaggaggtgtgtgccttgcaaccatcaggggatgctgcaggactgccctatggtccctacacagctgcttagtaagaaccattcactccaaggaacctgtgccctgtgctcaatgatggggactcaggagctgtgtcctctctggcctggcagagtcccctaagcagagacctgtgtatggtctcggcaggtgcttcctcccagggccctcccgagggggaaaccaaaccttcctcctcctcagtctggagtgtgagctaagcttcagctccagggctcagggaggggctgggcagtccttggatggaaacatatttgcatgagcagcccctcctctggcagaggatggagaagaagaggagacctggggcagctcaggcccactgttagggctcaggggctgtgtccaccatggcctggactcttctccttctcgtgctcctctctcactgcacaggtagggaaagtccttataaactgagtctcagtgtccaacctacaccatcccctgtggctcagacctacaagaagctttaccctgggaactgccttatcacccatgatgtctgtgttttcaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaagtaagacaaaaccctcccctctactctcctggtctagtgaaatcacccctgctggtggctctgaccaaatctagctcagggggtgacatctgttgtctcatcgacagcactggagctcccacggagaagtaggtctaacaaagtcctaccttgctcgcatttcacaggcagacatcccttgctcaggggtaaaatctctcagtgttgacattgaagaaggcaagagggctgggttggggttcatctcagctcagagtctagaagtgactcagagatgctgctggtctgagagttttaatatgagccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaagaagacctgagtaaatgcacagataatccttttttttttttttttttttttgaggcagagtttcactcttgttgcccaggctggagtgcaatggcatgatcttggatctcggctcaccacaacctccacctcctgggttcaagcgattctcctgcctcagcctcccgagtagctgggattacaggcatgtgccaccacgcctggctaatttttgtatttttagtagagatggggtttctccatgttggtcaggctggtctcgaacacctgatctccggtgatctgcccgcctcggcctcctgaagtgctgggattactggcgtgagccaatgcgcccagcccagataacccttttttttttttttttttttgagcaggagtctcgctctgtcgcccaggatgcagtgcagtggcgcgatcttggctcactgcaacctctgcctcccggttgaagtgattctcctgcctcagcctccctagtagctgggactacaggcatgtgacaccatgcccggctaatttttttttttccttgtggcaacggggtttcaccgtgtttggtcttgatctcttgaccttgtgatccgcccaccttggcctctcaaactgctgggattacaggcatgagccaccgtgcctggccccagataaccctttttatgtgagagtgtagagaatgttgctgcagctggtgtgggatgggggatggctgggttgagactgtgttgtcacctgcagtgtacacctgaggtgacatggttctgaacatcactttccccattgaaggcccgagtgacctatcacttgcttctcaaaattcaggaactaggtgactctaggagagtgcacaggaagctttctgcatattctttcaagagatttcgaggtcactgactcttttttcaagacttaaacacaaaatccacatccatcattcttgcgtaaagagaccattcttttttttttgagatggagtctcgctctgttgcccaagctggagtgcagtggcatgatctcggctcactgcaagctctgtcttctgggttcatgcccttctcctgcctcagcctcccaagtagctgggactacaggcacccgccgccatgcccggctaattttttgtattttttagtggagatggggtttcaacatgttggccagaatggtcttgatctcttgacctcgtgatccacccgccttggcctcccaaagtgctgggattacaggtgtgagccactgcacccggcccaagatggggtttcatcatgttgacctggctggtctcaaactcccaacctcaagtgatccactcacttcagcctcccaaagtgctgggatgacaggcgtgagccacagtgcccggcctagtacattgtttaaatggtgcatgtaaaacctcatggtactacaactgcctggtgacagactcaccagagtaaataactatcctgctgttctccaaccacatgggattccccaaacaaagatttgttgagtccaagatgcatcatgccagaactcttgcagtcatacacataatttgtttcattttaataaatacggttatcttttttcttcagtttattgtttttaatgtatcatcttctaggtttcattacacatcaaagatgaataatttctctcatctttaggacatgctgaaaacactcattagtgattttgaacagtattatttcctaaacatcctagttggaatggttgatcctaaaagctaccatgtgtcaggctcacctgagtgcagactgtggtctaaacaagctaaagttttaattcttccatcttcaaatacggagcatatttgcttgttttgctctttagcaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacaggtgaggaaatgagtccatggggctggtcagtgctctcgatttcattctgccataacaggactttgtgtagtcaccacctgagtcctatacagtgaacagccaaggagacatggacagattcacccctgaggaacccagtagaatgtgaagtctgccctgaggtcacgaagaaaagactcggggggctgcctggcctggccctgatggagggggccatggacagaacaacggggaggcaggggtgtctctgagaggctctggtcaccttgtcatacaatggtggtgtacaatgtcgcaccatggacactagggggcgcctgcgcaccattcctgagaagactgggtgtgatgagagcaggaccagcgccacctgtcctgcttggtgccctatgcttagggctcacagatgtcaactctccaccccctgggaccacacagccccacccctggcactctctgacatcctcaggcagaggagcttgacccagggcccagggtgggatcagaaagctggagggtctgatttgcatggatggaccctccttctctcagagtataaagaggggcagggagagacttggggaagctctgcttcagctgtgagcgcagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggcacagtgctccagcccaatggggaactgagacaagaacccccttcttcctcccccaggagggtgagtgccgccagctgctgctcacgcctgacctgtagcttctgctgctgcaggttctcccatgggccacggggcagccagggccctgcctaggagtggaggctccaccacttttgtcctcagagtcaggaacagggactccaggaatgagaatatcctgctcctgcagcttgggacacagggtctctgcactgacatcctgggctgaggtggcaggtccagctgtgtcttcacagtccttcctgtgcctgcccatggtgtggggagggagggagtggggaagggggtgtgggcctttgagcttcactagagacctgagggagcagaggtgctccccaagacctggactccttccctcaccctcctcccatcactctcctcactgtagctatggccaggtgagggctcagggctacttgaggaccttgctcagcccagggcctccatcccaggcattgtttccaaactctgtaagggctgtctctgaatctgtagaaacagttatttctatgtgcccaggactgggttagagggcaccaaccccaccccttgcaaactgctcctcacctcttagcgccccagtgaggagaagaaagagttagaaatcaggaatctactcagggctcccctctctcccctttcccagcctcccctggctttctctttctacagaaacaccaaggaggcagccaccaaggacgaggggaggcccaggcattataccaggcagcggagccagccagtccccccagatggtggagggaggtggtggaggtgtctgggaccagaaaatagtgaggaccctcttactgaagtgaggacgggtggcataaactgaggcccagatggtggaccagatctcctgagccatctactcatttcttcgtgtgttccagtttgggtaagaataggctaaaaaaaaaaaaaaaaggctttgaagaggttcctttcctcagataagaattcgtagaggattattgcccactcaggcattgaggggaggctgagcctcactctcaggccaatagaactgggggctttcaagggaatttgattgtactgagctcccagactctgacatctaagatttttgccctcgtagccgaacccagcactgataccaaaatggatgaaggctgatagataagcctagaatattctagctggcaccatctcgtggaaaagagaatcaagttagaatattgatgtgataaggtggcatcgcacagtgaggggaggagagcttgcatgggggagggtagaggagccactagagggctggacaaggaggagacagtctgaggtaagtttgtgaggaaaactccagatgcttcagagaagatggacaaggaggtaggcagtgtgaaggccatgggaccagctctagtcaccgggagagagtggtcagattcagcaccagtgtctggggaggaggtactgaagcctgggtgaggggagaggctcaaggctggccttaggacctgagtggggcacagtgatcacactgctggggggtccttcaagtgcaagggggctgcaggaaggcttgagctcattgtcacaatgaaaacttagacaacagctccccagccttgttcaaaggtgtcacaggactttttcctctccacatggcaacgtggagaagaaaacttatctctgagatatataagatgttagttctccataacctctcttgtcccctggctgaattcctatttggaaacaaaatgactctccagttttatatatgacatcctcacaaaaaaaaagttccagaatgagaaagatctgccctccctgacccactggtgaggaatctcagccttcaggacaaccagactaaatcattcatgccatctcccatgacagcatcatgtggaccagggagcctaccttatgggtttgggccacacactgcctgtccctagcattgcagctggggacacttacatgctgaactcatggctgggagatctgaggtccagacatgacaggaaaaggaaaaagaccaggagctctgcctaagtagcccccctgtgtgaatcactctaccctccaccctcatcttcagttcgtgatgggtattgtcttgtgaaaactgaaagctgggctgggacacaggcaagagagtctctgactcacaaatctccatcgtgggctctctggcctttctgatattcttttcacacatcaattctgggccaagacacatccatgctcatcaagaaggcattgataggagaatcaggtagcctccagagagacaggaagcagataaacaccctcatgttggcctcctaagcccagaggagaaaaaaaaaagttggaggggaagaagttcaagaagccacactagaagccactgattaccatcacctcggcacctgtcctccatctgcccctctttcaagtgaggaccagactcaggggacagcacctgcacctccccctctgtccatgcactgtgtagggagcctccttctgctctcatctcaaggtggctgctccgccaggtcagccgtatcactgctgagagtcttccctgggtcctggtcacagggtctgggatcagcagcaacctggctttgattcagctctgaccctgccccttcaggacacaaagcccattattaaagggataactgaactctcctagttcactcaaccttagattttccttctcagtgtccttctagaaagtgccgcctctactaaatgatttcatgttatttcctcaggtctagagctatttgatttccaaaattctatactcttctgttctcattcccggtcatggctcattttccctcagcagctaatgatgctaatcatgtatctaccccccattgtcacaaaaaagagagatggaagagttccttagataaatacagggttagcaaagaaaagtttcattatctcttaagaattactccaagatctggccaggcgtggtggctcatgcctgtaatcctagcactttgggagtccaaggtagacaggtcacgagatcaggagatcgagaccatcctggctaacatggtgaaaacccatctctactaaaaatacaaaaaattagccaggcatggtggtgggcacttgtagtcccagctactgaggaggctgaggcaggagaacagcgtgaacccgggaagtggagcttgcagggagccgagatcatgtctctgcactccagcctgggcaacagagcgagactccgtctcaaaaaaaaaaaaataaagaattactccaagatctaagaaaattaattccagttcttcaagagtttactcctcagaaacaacagcatgaatacattaggtagtgaatgttcttggtcttctcaatgaataacgtctgaaaggttcagagtatatgtttcaaaaaggtaagtgcataactttcaaaaaaatgtagtattaacatgtcaacaattttaattggtatatatatttctgaaaaaaaagcagtatgatggtaaaagaaatgtaaaaaagcctttgtaaaacccagtgcttacagtccaccaggatagcacctgtgaagcaaatttcctttgctgaagatacaccgccttttagaataatagcaagatagtttgaatttgtcttcttctctcacagcaatctaaaaattaacttaatcccatttatatgacatatctagaaatattcctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtgaacaagctcctggacttcttggatttctgaggacttgccctgccagggtgtctttctcaatcacaatctctccttcccgggagtccaattctcctagatcctgttatttatctaatgttatacatctgtatctacttggtggacttccctacatcttcacccgaaccccaggaatcttcaggtcatgcccatatgaccttagttctcctggagtcccttcttccttcttcccctgtgatcccaccaagtggagatctcttctcagaccctggagtgcagcagggacttctctggtctctgccccagggattaagggggtggaattgaggactcctgtgcccttcctatgcctgtgttttcatcagggtcagctgcacaaggtagggattcccactctcagagtatgaagaggggcagggagagatttggggaagctctgcttcagctgtgggcacaggaggcagcactcaggacaatctccagcatggcctggtcttctctcctcctcactctcctcgctcactgcacaggtgactggatgcagatcgaggggagggtccctgggaagcctatggattcttgctttctcctcttgtctctagaagcagaatcatgatgcctgtgtctctcccacttccagggtcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgctcacacagtgctccaggcccagggggaggtgagagaagaacccccttcctcctctaccaggagggtgagcgctcagctgctactgctcaggcgtggcctgtggcttctgctgctgcagcttcccccatggtccaggggcatccagggccctgcctcagagtagaggcttctctttttttctgttctgagaatcatgcacagcagctccttcctaggaacagggcctccagggaccagaacatccatctctttgtaccttgggacacagggtctctgcagtgaagtcctgggctgaggtgtcaggtccaactgtcatcacaaacctgatgcagaacctgtgtctccatcaacctcatttcctgatttctggaagttccgactgttggctttctgtccctgctcctcagggtgaatcgcttggcttctttcctccccagcctactctttttaataaaaccctttccaaggaggaataatgtccatacgagaaaacacctatatttataatataccatgacacccattttggcatgtttctggatccttgaaagcatcaccaccaccgagctatgcaagctgtgaccaaccccagcagctcctcatgaccctttgtcatctccctttctaccccaatgccctcccgggaagccacagatcctcctctgtcattagtgtttggtttccattttctggaaggtatcagtgttcacaaacattctcttgccatttgttgaggcttctttcactccgcacactttttgagattctccctgttgttgctgaatgacatctcatcccataaagggctcatcagtacctttgagggcccctagccattttgcctttcatgcccattcctgcatttgtatatacacatatagaatccagggtagcctatattccttttaatctgaattttaaaaaatcaatacattttctggggcccctaacagcgtcgagtcctgtaggcatttgatcttctctctccagtgatgctcagccctacttgcatctcatgcgattatactcacttctcgccattattcaacaattttgttttattctcttggttttaaataggcaatacacaaacaagatgccacatgagaactatggaaaccacttccccctcctacatcctgtctcctggcctgttggtttctctcagctgaagtgaccaggaatgcttacatttatgttccctcccagccaggatctgtgtgtagaaacaagggggtctgtctgtgtctgtgtgggcaaccacattatgttttctttagtaccactacaaccttactattgacaaacaactttttaattcctgagactgtgacttcatgtaatcctgacagtagcccgattattgcttttgaggcagtggtcctgattggagaggaactgtttgtgacctggggatggcgttctctaatttatcaaatgtaaacactggaggtcagttaaatttgaattcggtaaaacaatgatgaagaatcaataggtaggctgggcgccgtggctcacaccttaaccctggcacttttggaagccaaggttgatggattgcttcaggccaggagttcgagacaagtctgacccacgtggtgaaaccccgtatctcctaaaaatacaaaaattagctgggcctcatgacatatacctgtaatcccagtgactcaggaggttgaggcatgagaatcacttgaacccaagaggcagaggttgcagtgagctgagaccgggccactaactccaggtggagtaacagagtgacactctgactcaaaaaaaaataccaaaaaaaaaaaaaaagagtcagtatgtgtatcccccagacaatattgtgtatttaaatataaacataactgggtgccctttaatttatctggcaactccacacagtgtcacaacctggaagaagcatagctggggcagtcatccccttactgatgctgggtctaggggcttaactacaaagacagagctttgctagcaaagatacactcaagtgagcacatcagtgagcatgaaatgcatgtgatataattcccaatgaatgatgcctcctcacttctctaattattctttctattatccttcaagtctgcagattcagggcctccccagggattgcttcagcctgagcgctagacaagtgatctcatgtcctgtcacacccagatgcatggggctactctgtccccacacagaggggcttcagcctggggtgcataagtaacatgtgagagagagaagagctcagcctggctctgcttatatctagtgagagaccaacttcgggttcatttgatgctggaggctggtgagctgagagcagaggagagaccaagccttagagtgcagggctttcaggagagaaattgggaacctggaaatgggccacactcttcagtgaggaagaagcaggcagctctaggcacagccctgcattcctagtggcttccccttcatcaagcttgactccctgctttgatgtctgtcagggaatctacttcagcaaggtgaagatcccagggctttactaaaaatagcagtagaccaggcaggtatgtcatggttcaagagttctgtgcacagaaataaatacagatgcatattcacaagggccctcacagttgtctcttttggagtggaagagatgaagaaaggcagggagaaattgaaagactcagtcggtctgggcctggggcagcactggatgctgtggacttatccctgaagggtctgcaggtgaccacagccaggaagccagcccctgctatgaccctgtgtcatctgctcactgctcactgagctcagcagctgtgtcctcacaggaaactgggtgcagccagcttggccttctccaccccacctggaaaatgtgggcaggtgactgtcagcattgagatcctatgaaggggctgggagacaagggaagagggctgatttgcatgaagcaatcattccacacccttatctttaaactatatcccattaatggaagctctggggccatccaaacctgatcaatctaagaggggttatcagctggaggtggtcagagtgaggaagaaactggcttccttgaaagactcatcaacacagccaccaactctgggacaaatggggtgactccctataactgtcacccgatattagccacaggagcctgagcctagtcccctcaccttattgcttctgattctggtccagtcccctgttgtccctggacccttgcctatgtctgagtccagggtggcaggggtagccccatctcagtcaacatctatagagaggtaagagctactacggcttcaagcagagtccacagttttacccatgagggcctcttttgctcccccaccctgtcacacaggtgactactgctgtgggtctggtggagtggcccctggcccctgaaggacacaaggtattccttcctctctaacaccaggcatatagtggagaaggtatgggtgggtatagaacagattggcttttctagatgcaaatcggtaagaccctggctacagaaaaattatttcacaaaaccccacaccctttcgtgacaaaaacactcagtgaattatgaatagaaggaaattacctcaacatagtaaaccctatgtatgaaactcccacagctaacatcacgtgcaatctgaaagactgaagatatttcctgtaacttcaggaacaaagcaaggatgcgcactttcaccacttctattccaaatagtattggaagacctagccagagcaattagccaagaaaaagaaataaacagaaaagaaattagaaatgaaaaagtaaaataatctctgttttcagatgacctaatcttatatgtagaaaatccataaaacttccaccaaaatagcaaactcttctcagctaagggaccatgttctaacccaatgaagggaagctaagaaccttgataaaaggttacaggaacagctaaatggaataatcagtttagagagaaacataaataacctgatggagctgaaaaacacagcagaagaacttcatgaagcatacacaagtatcaatagctgaaccaaaccagtggaagaaagtatatcagagactgaagatcaacttactgaaatgggtgtgaagacaagataaggcaaaaaagcaggaaaagaaatgaacaaagcctccaagaaatatgggactatgtgaaacgaccaaacttacaattgattggtgtacctgaaagtgacggggagaatggaaccacgttggaaaacacacttcaggatattatccaggagaaattccccaacctggcaagacaggccaacattcaaattcaggaaatacaaggaagatcactaagatactcctcgagaagagcaagccaaagacacataaccgtcagattcaccaaggttgaaatgaaggaaacaatgttaagtggatccagagagaaaggtcaggttacctacaaagggaagcccatcagactaacagcagatctctctgcggaaaccctacaagccagaagagagtgggagccaatattcaacttcttaaagaaaagaattttcagtccagaattttatatccagccaaactaagctacataagtgaaggagaaataaaattctttacagataagcaaatgctgaggtattttatcaccaccaggcctaccttacaagagctcctgaaggaagcactaaatatggaaaggaaaaactgctaccagccactgcaaaaacacaccaaaatataaagaccaatgatgctatgaagaaactgcatcaagtaatgtgcaaaataaccagttagcatcatgatgacaggataaaattcccacataataatattaattttaaatgtaaatgggccaaatgccccaattaaaagacacagactggcaaattgggtaaagagtcaagacccattggtgtggtatattcaggagacccatctcacatcaaaagacacacataggctcaaaataaaggaatggaggaatatttaccaagcaaatggaaagaaaaaaaaaagctggggtcgcaatcctagtctctgataaaacagactttaaacaaacaaggatcaaaaaagacaaagaaaggcattacataatggtaaagggatcaatgcaacaagaagaactaactatgctaaatatatatgcacccaatacaggagcacccagtttcataaaacaagttcttagagacctacaaagagacttaaactcccagatgataatactgggagactttgacactccactgtcaatattaaatcaatgagacagaaaatgaacaaggatatcccatccttagaaaaccccatcgtctcagccccaaaactccttaagctgatgagcaacttcagtaaagtctcaggatacaaaatcaatgtgaaaaattcacaagtatttctatgcatcagcaatagacaagcagaaagccaaatcatgagtgaactcccattcccaattgctacgaagaaaataaaatacctaggaatacaacttacaagggatgtgaaggacctcttcaaggagaactacaaaccattgctcaaggaaataagagagaacatgaactcagctctggaccaagtggacctatagatatctacagaaaactttaccccaaatcaatagaatatacattcttctcagtgccacataacatatattctaaaattgaccacataattggaagtaaaacatccttagcaaatgcgaaagaatggaaatcataacaaacagtctttcagactaccgagcaatcaaattagaactcaggatgaagaaacttactcaaaaccacacaactacacggaaattgaacaacctgctcctgaatgactactgggtaaataatgaaattaaggcagaaataaagaagttatttgaagccaatgagaacaaagagacaatgtaccagaatctctgggacacagctagaacagtgtgtagagggaaatttatagcactaaatgccacagcagaaagtgggaaagatctaaaattgacaccctaacatcacaattaaaggaagtttagaagcaagagcaaataaattcaaaagctagcagaagacaagaaataactaagatcggagcagagctgaaagagatagagacgtgaataacccttcaaaaaaatcaatgaatccaggagctggttttttgaaaagattaacaatctagatagaccactagctagactaataaataagaaagaagaatcaaatagatacaataaaaaagataaaggggatatcactactgatctcccagaaatgcgaactaccatcagagaatactacaaacacctctatgcaaataaactagaaaatctagaagaaaggatagattcctggacacatacaccctcccaagactaaatcaggaagaagctgaatccctgaatagaccaataacaagttctggtattgtggcagtaattaatagcctaccaaccaaaaaaagcccaggaccagacagattcacagctgaattataccagaggtacaaagaggagctgataccattccttctgaaaccattccaaagaatagaaaaagagagactcctctctaactcattttgtgaagctagcatcatcctgatatcaaaatctggcagagacacaacaaaaacagaaaattccgggccaatatctttgatgaacattgatgcgaaaatcctcaataaaatactggcaaactgaatccagcagcacatcaaaaaacttacccaccacaatcaagtcggcttcatcgctgggatgcaagtctggttcaacatacacaaatcaataaatgtaatccatcgcataaacagaactaaagacaaaaaccacatgattatctcaatagatgcagaaaagccctttgataaaattcaacatcccttcatgctaaaacctctcaataaactaagtgttgatggaacatatctcaaaataataagaggaatttatgaaaaacccatagccaacatcatactgaatgggcaaaagctggaagcattcactttgaaaaccaccacaagacaaggatgccctctctgaacacttctgttcaacatagcattggaagttctagccagggcaatcaggcaagagaaataaagcgtatttgaataggaagagaggaagtcaaattgtctctgtttgcagacgatatgactgtatagttagaaaacccaatcatctcagcccaaaaactccttaagctgataagcaactccagcaaagtcccaggatacaaaatcaatgtgcaaaaatcgcaagcattcctacacaccagaaatagacaagcagagagccaaatcatgagtgaaccctcattcacaattgctacaaagaaaataaaatgcctaggagtacaacttacagggacttgaaggacctcttcaaggagaactatacactactgctgaaggaaataagaaaggacacaaaggaatgaaaaaacattccattctcatggataggaagaatcaatatcgtgaaaatggccatattgcccaaagtaatctatagattcaatgctattcccatgaagacaccactgactttttctgcagaatagaaaaaagctactttaaatttcatatggaaccaagaaagaacctggataaccaagacaattctaaacaaaaagaacaaagctggaggcatcacaccacctgacttcaaattacactaccaggcaacagtaaccaaaacagcatggtactggtaccaaagcagataaatagatcaatggtacagagcagagacctgagaaataacaccacacatctacaaccatctgatctttgacaaacttgacaaaaacaagcaatggggaaaggattccctatttgataagtggtgctgggaaaactggtagccatagacagaaaacagaaactggaccgcttccttacaccgtatacaaaaattaactcaaaacggattaaagacttaaatgtaaaacccaaaaccataaaaaccctggaagaaaacctaggcaattccattcaggacacaggtgtgggcaaatactttatgatgaaaataccaaaagcgatggcaacaaaagctaaattgaaaatgggatctaatcaaactaaagaacttcggcagagtaaaagaaacaatcatcagagtaaacaggcaacctacagaatgggagaaaatttttgcaagctacccatttgacaaaggtctaatatttagaatctacaaggaacttaaacaaatttacaagaaataaacaaacaaccccatcaaaaaatggactaaggatatgaacaaacacttctcaaaagaagacatgtatgtggccaacaaacatatgaaaaacagcgcatcatcactggtcattagagaaatgcaaatcaaaaccacagtgaggtaccatctcacaccagttagaatggcaattattaaacagtcgggaaacaacagatgttggtgaggctgcggagaaattggaatgcttttacactgtcagtgggaatgtaaattagttcaaccattgtggaagacagtgtggcaattcctcaaggatctagaaccagaaataccatttgagaccagtaatcccattcctgggtatatacccaaaggattataaatcattctaccataaagacacatggacacatatgtttattgcagcactctatgcagtagcaacgacttggaaccaatccaaatggccatcaatgacagactgaatatagaaaatgtggcatatatacactgtggaatactatgcagccataaaaaagaatgagttcatgttctttgcagggacatagatgaagctggaagccatcattctcagcaaagtaacactgaaacagaaaatcaaacactgcatgttcatactcataagtgggagttgaagaatgagaacacgtggacacagggagggaaacatcgtataccagggcctgtccgggggggctgggggtcaaggggagggagagcattaggatgaatacctcatgcataccgggattaaaacctagatgacaggttgataggtgtagtaaaccaccatgtcacatatatacctctgtaacaaacctgcgggttctgcacacatgtatcccagaacttaaagtaaaataaacaaacaaataaataaataaataaataaataaataaaataagtcccaccaaaacaaaaactgttagaactattaaatacatttggtaatatttcagaatacaaaatcaacacataaaaccatctaatggacagccatgatggctcatacctgtaatcccagctcttggggaagctgaggtgaaaggattggttaggatcaagagagttcaataccagcgtgggaaatgaagtgagaccctgtctcaaaaacaaacaaacaaacgaacaagcaaacaaacagggttcttatatttctatacttaatcaaccaaacaggaaacaagaagacaggacacaacgcaaaatgaaattaagaaaacaattcaatttacaatagcatcagaaagaataaaatacttaagaatcaagaaggggactcttctatactgaaaactataaaacattgctaaaagaaattaaagaatacacaaataaatggaaagaaacattgctaaaagaaattaaagaatacacaaataaatggaaagaaaacatttgttcatgaattgaaaaacttgatattgttaagaaatcaatacaaaccaaaagaaatctacagattcatttcaatctctattaaaattccaataatttttttgcaaaagtagaaaaaattaattctaaaatttacatagactatcacaggactccaaatagccaaaatgatcttctaaaagaagaacagtgttggagatttcacacttcctgatttcaaaacatactacagagctacaccaatcaaagcagagtggtacagatagacagacacagagacaaatagaatagaattgagcacccagaaagaatctcttagttatatgatcaaatgattttaaataagggtagcaagaccattgagtggggaaaggacagactccataaaaaatgtttttgagaaaactggatatccacatgcaatgtggaaatggataaaagacccaaatggaaaagccataactgtaaaaatcttaatagaaaacactaggaagaagtttaacaacattgggtttggaaatgatttcttgtatttgacgccaaaagcacaagaaaaaaaaaagaaaaagaatatagataaattggatttcatcaaattgtaaaatttatgtgcaacaaaggactctatcaacagagggaaaatgcaaatcatggagtcagaaaatattttgcaaacattgtatctggtaaggtgtccaggatatagaaagaactcctacaactcaacaggaataaaaaaatagaaacaatctgaataaaacatgggcccaagacttgaatagatatttctccgaagaagatcaataaatggccaataagcacatgaaaagatgtttagcatcactaatcattagagaaatccaaatcaaaccacaataatacacaacttcacacccagtaggatggcgttaccaaaataatagaaaataacaagttctggcaaagatgagtagaaattgtggagaaactataaaatgatgcatccactgtggaagccttatggcagttcctcaaaaaattaaacatagaattaccattttaacagaattttcacttctgggtatgtgcctaaaagaattcagagcagggtctcaaagagaaatttgtacacccttgttcatagcagcattgttcacaatagctaaaaggtagaggcagcccaagtgtccatctaatggataaatgggatatagtatacacacacaagggaatagtattcagccttaaagagagtgttctggcccatgctgtggcacagataaacctgaaagacatcatgccagcagaaataagctggcttcaaaagaacaaaaattgtttcattacccttatatgaggtacctagagtagtaaaagctaccgtgacaagaagtataatgaagtttcccaggtccttggggtggagagtagggggagaatggacagttatttgttttttgtttagtttagttttgctttgttttgtttttgagactgagtctccctctgtcacccagtctggagtgcagtggcacaatcttggctcactgcaacctctgcctcctgggttcaagcgattctcatgcctcagcctcccaagtagctgggattacaggcatgcaccaccatgttcagctaacttttggtattttttagtagagatggggttttaccattttgctcaggctaatcttgaactcctgggctccagtgatccaccgaccttggcctctcaaagtgctgaaatcaaggaagtgagccaccacaccgagccgggcagttcttgtttaatggttgcgaagttttagtttgggaagatgaaaaatttctgaagatgaatggtagcagtgtgattgtacaagttgatttacttagtgacactgaagtgtacacatgaaatggtgaaggtaacaaattttatgtttgaatattttaccacagtcaaaaagaggaagatttatatttggcaccattgctctacttccaagaacagtagaaagatacagtagtaggagagtgtgcacaagtatccaggacgtctttcattttttgccagccctgcagcatcctaacaatccaagagagcaggaggtgtctcattacaggggactcagaataatgtgaagaaatctggggcggggtgggggcataatgatagcacacaggtgccggacccagtccaggagtggccacaaatgcaagggctgcagaagagggggagatgaagctggtggcagtggtagcagctgcttcagctggaaaggggcatctgttgctttccaaagtggttcacagttgaaatatctggcatagatacttcatcctgcctacctttcatgactaactatattttcattgcaatatatgcagtcatagtgagaatacctatttcctccagatacaagcaaacgtgaaggaaatgtgctttagtgctttggccaacttgacatggcagtcacaaaaagaggatgaatatccaaagacaaccttttccaaagataaggttattataccgtttattgtaaatactggaagtgcacaacaatcattcagacacctgggaaaatgacttgaccaaatacagttgtgaaaacaatgagtaaagaaagtgatatattcttggtaaaagaaccactggatctagtgagtaaagaaccaaaaggagatgaccctagattggaacttttagaccaggaccttggtaacattggtcctgtttatgcaacaaaaacaaagcaataccttgtctaccagtgagaatctgaatgagggaacagcaacaggaagcagcagaaaaaaggaaaagaagctcagtgcaaacagctgaatggggagatcacagggaccaccaagaaggcccagggttttctgctcagtgccttccctctcatacaccttagagcacccactgaacaaagataactaccagtatattctagctgagcctgatccccacgcccttggtcctcagaagcttgaacttgactgctgggcaaaattccttattcctggagacctctacagaggctgcttgtatgaacaggttttgttagcctgacataattgagctccccagttaaaagtctccaatgacctgctggctgactgtggttgaacagaaggtctactctatggtacgggattctcatgggttaccttgatatcaccatggatgagatgccaccagacactgctgccagactgggttggtcccagtctttagataactgtcaagcttccttagtttatgataagtttaactattcttgggagaattaaagggaatgaagttccaccagtccactggcaaacactactcttctagctatagacaaggagacatcctgggattttatatgaatcttcctgaagaaacaaagacagtcaagtcattgcctgatacttacaaagataaggccttgataaagtttaagaattatttgtgttttgaggaaaaagactttgtgactgaagcagagaagagcctaaaagagacttcccacagtgagataagattttataaaaatggtgttagtcaaggcatggcttacaaagatattttcaaggggctttactttccagcaatcttaccagaaaacaactgcataatttccatgaacattggactgtgcttcaagtatcctccaaaggatctcacttactgccctatgagtgacatgggctgggatgctctggtagagcacactctggctggtgtcttggtgctagaaatggattcaatcactggacaagaaagtccttcaggggcaaacataaggacactgagggtcatcttattctacctgccttctctccttacttgtatcctaggccagcctatgctagcgcaactgtccacagatctctctctctctttctgtctctctctcgtgtgtgtgtatgtgtgtgtgtgtgtgcatgtgtgtatcaaatgatcaaacatcttcattcaaaagtccaagccctgcagcatcatgagacagtgctaccacacatgaagaaaatgttcaaagggcaccaaatagagatcgcatgatccaaagttatttctgatcccagaaaagaatggcacacaatcaatatgaatagtattagatatcaaaattatagtacaatctcatttgtttttaccatagattcaaactctctttagcatattggaaagcagaatccatgttctactgatgcaattccccttgaccatcatgaaagaattggactgaaagcaggacatttctgaagtctctggaggatacgtaacatgactgttggagggaatgcacataggaagaggtagtgaattatgtgtcaagtgccccaacaaaaggctgtcagtgtttgtctctgacacattgttggggagaaaggtggagtcacaggacacactgccatgggacccacgagacttgatcctacatcccacagcgggcagcctgcatcaacgtggtcatgcagggatagaaacacagccacagaaagctttcacctgcccaagcagcatctcccaagagccagcatgggtgctgtctctgctctgcttcttcctggactgtgtctcagagccctgagttctccctcacccagtttcccaatccccctcttctccactggttaccaggggttaggggagtggggaggggaaataaacgtttaaagggtacaaacttttcacttgggatgatgagaaagttatggaaattcataatggtgatgactgtatcacttttttttcagaggtggtaacttgctctgttgcccaggctggagtgcagtggtacaatgatagctcactgcatccttgaactcttgggtctaggcaagcctcctgcctcagactcctgagtagctgggactacaggtgcaagccaccatgccaggcaattctatcacattgtgaatatacttaacaccactgaattttacagttaaaagtgatttaaatggcaaattttatgttgtgtgtattctatgacaattaaaaatacacttgttcaaatgtcaaaatatatatgatgttatattcataaaattttccttttcacacttatatatttatcctattctaactcattctcatcaattaaaaaagtactgtaattactggtcattatgtactaaattttccataattcacattgaagccttaacccccaatattactgtatttggagacagagcattacagagggtaattaagatgaaatgagatcataaggaccggcatccttataagaggagattagaaaatggacaacataaaatgagatgaggacagagtgagaaggtggtcatctacaagtgtggacacatcttcagtttgtgtggagtaacagttgaagggctcgcccatcctataatgaaagttggaacaggtgccttgggcgggctccaggattaactgatctagtcactgcatcccactgtgggaccccagagggaaagaagcactgtggagattcctgagacattagaaatggagcctgagaaatttccaggacacccacatgggctccaggtgaagcaggggcccagaaggccttgtctgagccctgagtgtgacgcagcacctggccactagggggaggcaaactctgtgaatcctaagggacctgagctcttgctctgagccctgcccttgttaatcaccagccctgggagggagccgatttgcatggaatgtgatgtccctgcccacttcttcactgagggaataagaggctttagggcctcaggctcagctgagagactgaagaacccagcattgcagcagctccaccatggcctgggctcctctgctcctcaccctcctcagtctcctcacaggtcagggtgggcagtgggctgggcccccaaagggacccccacctcccagcctccatctccccatccctgctcttcctcctccaacagctcatcagccacccaccaacaggagccctcatgggtgtctgtgtttccagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgtaacccacagtgacacaggcagaggggaagtgagacaaaaacctcccggctgatctgctctgtccacacttccttcccactggcctgactcacatttcagagggctgtctcttaactctgtatttaaagttttcaccttcccagacattttggagttctaattcacagcatatgttccctgtgtgtaaatattttctcaagagcttttgaaacattgaagtttgcacaccaacatttgtggtttttgccactcacctgtcccctgatgggattgaagtttccaggttgtggaactgctcacaggtgcgtttatcaggaaatcaccgtcaccagctcccacgacctttgtccatattcaacatttgtgagctgcctattcaatgatgggaactgacaatttccctggagacacaaggccttcaccctgactcacagtgtcacataatcgacgtggacttcagccatctccagtcacctccatgtgcacagagctctcatggtacatgtgcttggctgccctagaaagagagaatggacacacaccaaagatagtagaatgtgagcctgctctatatctgagattctgaaagaggcccccactgccttcacagaatgaattccttcacatgcagggagagagctctggtggaatcactctgcaatgctttctgatgacaaatacctggattgaggtcaaatttcacaggttaataacccttttcaagactacctccactacagactccagttcccaggcattaagcctgaggacccttgtagacaaccaacatggggctgtgaccagcaggagcaatgggtaactgtcccaggccctgccttggggctgctcacagccgggtgagccccactggccacaggctggcagaggctgagctgctccctgtgctcgctgatgaaactcagcagcctagtgctctcagggtccagcaaagcctcttgggcagggtcctgtgcctgttcccaacagccgctccttcgaggaccctcctaggcccacactcgagcagctccttcctcaacctcctctgtcctcacatccccttttgggttcctgaatcagtgatcaggtagggtctcatttagccagaagggagggagtagatttgcatgaacagcttcttcttttccctgagggcagaaggaaaaatagtcaagcctggggaagcccagcccaactgtgaggtccagaggctgtgtccaccatggcttgttgcctgaactcctctggtacccaatccttggtctatgtttatagactcaatgaaaatacctccctttctactggcctcttaatgctaacagaatcattttgtcccctaagcacaaatagcctttcgggttgctgggtgggatgacaactagagcagaagtctagcatgtgcaaccccattcctggcccatacatgtccctgctcttggcccagtctttgctggttactccctgaactctgaaacttcagggaagttgagtttctctttctcttgagattgtactcttgaggagctcctgaatttccaggtatagggtgacccctcctcattaaggacatggctctcagacttatccctggtttacttccccaggtttaggtctgtgagttctaaacagtttccctatgtttctttggttgatattttggttgatatttccctttgtttctttaggttgatattacattgggtaattacattggttgattacattgggtaaatatattcttgtagatatacacattataaactcttcccccattaagctcttaataaataaacttgtttgggtgccaatgtaccaatgtaggtaagaagtcttgacgcttttttttttttcttctgcaggagcagaggagaacctgaaaaaaaaaagagagagagacaagttcagcttataatactgttattttcatataaactctcctactttaaaaagtacaaaactagacctatactgaaaatatttttaaatatatcagagtatctgcatctgtcactgtggagatggttgcttgctctaccacagagcacaataatactgagcctcatcttcagcctaggcccctgtgatggtgagggcagtcttgtcttcaagcacagagtgtgagaatcaagtggggaccccatgcagagatggggacgtcagacacacacaccctggctcagcctcacctcatgctcctaacatctccatcttcttcacacagaggctgctgctgcttctggctaacacgggctcctgacgctggttctccagggcccaagagaaagtggtcacatatattcttctaagctgcaaaatttgtatttttaacccaacatgttattataacaatgtgttcataaagcacaatactaagatctatcatcaattgcacagttatgagttatttataggagtggcaaaataaaaagttacgcacacacacacgcagattcgggcaggccagaatttaattacaggagcaaagtttgatattagtgacacaacataacaatgatcctatgtataatgataaacatagcaatggaccatatgaagctttgaagaaacatagtggaaacacagaaaaaatctccctctcaccaaattttagaaaattctaaaaaaaattaaaaatttttaaaacccctcaaaactgagttaatttataaaatatgatacaaaacataaagtttacataactttaacactcttcatactcagtaaatgcaggttctttctccacaatttaatccagtgtaccaaaaccgagccttcctgtttgctggaggaaaacctcagcaccacaacagtagaaaagcaccaacctctctgcccacagtgcatcttccctccagagactccgcaggactctgcatggtctcctgagggccctgaagtggaggttctgtgatgagaagggggcatggatggcacagggcaagaatgtctgcagggtaagagtgttagaaggacaagcttcattcctctctgaaacaagcctatcttacatgatttatctttattcttctctacaaaaaaaaaaaagtcacaaagatagctgcaaagaaatatgtgaaattatacaaggctaagataacaaagaatattggaagaaaaagtaattatgacatcttctatcgaaacattttaggccaagcgtggtggctcatgcctgtaatcccagcatgttgagaggccaaagcaagagaatcacttgaggtcaagagttcaagacaagcctgagatcccatttttattttttaaaagcagcattaaaaaaaaaaggttcatcatagtctcctcttcccacagttaataatgagaatggagaaagttcaaaaagtgaaaatttaagcaactcttatgtacccataacaattttttaaattttgaaaaagaaatgaaacccgtagcacaactgaccaccagcacacaggtgcctcttcttcagctgcccctcctgaagtgacaaccaaacccaggggctcagcacaatgagctctccctctggccatacattccctgtgaggccccatctactctcatcccaacacaattgctccccaggcatctggggactgctgctgagattctccactcatggggtcctgggcacagcggtgttatcccagtccccctcttcctctgtgtcctgggagctggaatcagagtcagcctgatctggcccaaagcctacaattaagagccctgagtggcctctcctgctttccccccacattggactcttcctttcagtgtccttcctggggtactgtgtcactactcaataatatcttatgtcctcagtgctaggcgtttttcacataatatactcttgttagtttctcctcacctttccaagctcagttatcaactctaggctgatgatcctaactattcatttacagcacattgtcatataaaggccagcgatatctagaaaaaaaagtgccaataaatgtgtgtactgcatcttacgaatcactacaaggataccacaaacaatatccctgtatttaaatagagttcactcttcagacacaagagtttaagtggagttcaatataatagtttatatagataatagttaatataacagtttaaccagtctgtctgtggctaaaccagtcaccatctcctgcactggaagcagcaacaataagggtcttgggcttgtgtcctggtaccaacaatgaccaggaagtgccaccaaacctctgatacatatgtacggatccatatatttatatccatatcctgcggcgaatatccacctgcagggatccaggactgaatctcaggctaccggtctggcaaggaggcattgctgagcatctctgggctacaggcttaggacaaggctgatctctgctgttggctttaggcagctccatcgaggtccccacagtgctgcagtctggggaactgagacaaaggcacaccaggtttccaatgagtatgagctacctgcagcaccacccactgtcaggacaactgggctctttaccgtttgtgtgtatgtttcctggtgctgccactaaccagtgcccaggactcaagtcagggacagtgatctagagaatgcagctttgttctttcagagccagcccacagagggagcccttagcaatggcacattgtcagactgcttcaaaagaatcagaaagcctttgattccaggaacaggctgctctggggacagacccgagatgggtcaggggaggcagggacagattccaggtggctctctctcaggcacatgcactaatgcagaggtctaatcatccctattgtctactgaacaactactatgtgccaggctatggggagggctcaggatacagagttaccaagacagacaaggttcctgtcttcatagggctgacaccaaactaaagagagacagtcaagaagtcaatgggaataaggcatattgtggtgtatcaaagaggtgacactggccagaagggggagaatgatagaacgcctttagtgggtcgtaagcaaggaagacacagccttttgtttgagatttaggaggaaagtccagcttcttcaaggaagacaaaaaatgaggggatagtgcgaaggcaaaaggtccagttagaaagcagtggcattgtgcacatgagagatgaggtatctagcatctgatgtagcagctgagctgggaggaatgtgcatgacccacaccatggtgagaaggactagaggaaagaggtcactaggttgaggccctgaccttgtccttgtgatggaaacctgacaacagcctgcagctgcgatcaagcatgtcactctcctcttctctctggaaagctcataggactcaggactcattgctgcccttccctcttattcagtgagatttatttgaaccatcacttttcacacctggacagagacctgcttactttctcttgagcaaaagcactaagggtcgggacagagcactgtagagcacatgggatgatgccctacacactcaaggggctgctgttactgctgttaaagctcacgatcaaacctcccagagctctgtcagaaaccatgagacgggaggtgtcagtgctgaagtagctgatttgggggcacactgatttgcagtctgtgcagtcctgatttggaggtgtgggacagtgagggctgaagcccagcatcggcaagaggttcctgaggtgtctttatgtgccagggtccttgtgaccacctcagtgatgtgtgggggtaaaggtcaattgaaaagctggagagcagtggacaggcaggattctgtgtctgggtgagggacgggatgttcagctcctgcccaggcatccttatttacatttctgtttacctctcttcttccttgtctccttcccagggcagggttccagggctgttgtatctccgctgctctttctccatcacaaagagagcaagagagacaggttatgtgatgactaattccctcttcacactcagttgtctgattgtccttaggaattcttcctgaggatgggaatgtgctgttttatttctcccttacagtgagatcctagccatttgtgaggccaaggagattgaccccatcctgtcgatgaaggattatttataacacacatggtcaaaaagaacatcatcaacttctgcacaagtcagtccattcgtcagggttatagaagtgcacgtctctcagctgtcagcaatgggcttcaaatccccaggatgactaacttgtcaggatgggatcatccacattaagatgtttctttacagttagtgactctattcactgtgtttcccctgctgagatccaacctctatgagattgtttattggctgttttctgtcttgttattgctgaaaacacttcctggcactaaggacagactcaatacatgtttattaaatatgtgagttcacctacattggaatcccaggaagaggtacaaacctgaggtcaagataataatttttttaaaaattctgaatattttgtgtttgagattccaagttcattcaatggaagatactaagtaatgacttttgcctttggatttggttagcaggagaaggatatggatataaaaatgcaaatatatatatcacacatacctccccatggcccagagacctgaaagcccagctggtctctgcagctgccaattgcagcctctgttcactcatttatggtctgattgtcatggatccatatatactggatcccatgggttcatgtggagaaagtggagaggatgcgatgggctttcccagtcctgataaaagaaaccacaggaagcgaatagatcataaagcaaattctggggacagaaaaccctcgagagcaaataaactgctaatatgggtgagttgggaaaatgtctggcaatatttatataactaagaaactttacattagatatccttccttcacaatattcattacggagctttaaatcatccatatgatcaatgcaattcaaacattaaactcatcaaccccaagtcccatagcagactttgatgaggaaattcttgaaggaagaagggtgggtttgtgagctctgtgtccacagaagagatatttctccactaggagaactgggtaaagccaataaataattaggaatgtagatgcccaactggactatattctaatccaatatgcaatgctgtgagtcctgcatctgcaaattgttaacattcattgtgcttccttcagtttcccaattactacaataaattaactttagacatggatgattacagaacagatcaattaatgtgagagtccttggaatgtgttgctttaatccacaaaaattacggaacacttcaaatgtatatatttgttaatttatgtaccaattgtattttactgcttcgttgatctgttgtaaaaatcacccagtgagggagtaagctgatgggtaaaatgggttgaaaaattaaacaagatgaaccacattgatgatggtcaaatttggctgatgggtgcaaacaattcattagaaaagtatctgtatatttgtatggttcaaaagtttccatgctatccagtgtttaaaatatccttgtttgtaactgttctgcttttaaccggtgtacaatgtggacaaaatgtaagcttacactctgactttgagtagaagcccatcttctcccaacaggcagaggagaagctggtgtggagaacatggaaaacacaggagctcagggtttcccaggacagagaagcgagtgagcctggagccctaaaagcaagggtggggctgtgagttgggctgtgggtgtgtgcaggggccacagtgtgaagggcatgcttcagaggccacaggatttggattttataataagaatgatgagttactgaaggggtttaagccaggtagtaccttccctgcctcatctatatgagagggatctgtatccaaatgcctggaggagagcgtgcctgagaaaagtgagtgatcctgattctagattattcactaaagcacctcgtgagtctagaaacccaagggccatttgcacagttagcacaagagtagacgtggcaacattgagaagtgatggtctctgcctttgtctcctctggcattcaatacttgcaaaaacactttgcaggtaaaataaatactgatatttcaaataacctgaaagcatccagtaaaaaaataaaggtggcaatatcaagatacaaacaaattgtataacatttaggacaaatcgtttaccaaaaaatatgacacgactgtgaagaaagtgacgttttacttagggagataatggctaacctcttaaaacagagatatatgtcacactgtgacaggaaagtctacaaaatctcttaatgttcctacatcacaaaattgagtcaaatctctataaaacatatgaaaccattagatgtataacttttgctaaattgctgtctttaacatgtattggatcatttatttttcctggaaaattctcattcttcactgtccttttgaacaaccccagctgcccttcaacccagctcctcagctgacccatttttcatgatgcccaccctgatggcacatgtgggcaactcgatttttctagaatgccatgcaggggtgctgacaactttaaaagttatatagtacatggctgcacatcccacagaccaagactacttctgggagtgagaaatcacagtaataatgcatagcatgatagaagcagtgtctgggaatcagaccatggatatgtgaatacagacagtgactggagagctgcagagaccagctgggttctgaagtctctgagctttgggaaagtgtgtttcctgggaccagcgtcggatgttgtggggctgccctgtggttctgacacagctgctcagtaaggagcattcactccaagaaatccaggccttgaggctgggccctgtgctcactgatggagacttggcagctgtgtcccctctggcctggcagagttccctgagcagggacctgtgtatggtctcaacaggtgcttcctcccagggccttgcaaaaagaaaagcaaaccttcctcctgctcagtctgcagagagagcagagctgcatccccaggtctcaaggaggggcccggcaatccctgggtggaaacacatttgcatgagcagcccctcctctgcaagggtgggaagaaaaggaggcctggggcagcccagtcccactgtggggtaagcggctgtgtccaccatggcctggaatcctctcctcctcctgttcctctctcactgcacaggtaggaaaaggcctcagagaccagggtcagccacacagcctgattctgactcttgtgtcaaagatcactaaaaaaaatattaccttggtttctgtcttaaagcctatatatgcctgtgttccaggttccctctcgcagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggatccaaagatgcttcgagcaatgcagggattttagtcatctctgggctccagtctgaggatgaggctgactattactgtatgatttggcacagcagtgcttcttacagtgacacacacagatggggaagtgggacaaaaacttcaccctgatctgggtcttgttctgtaacagtttttaaattttaaaataaccagccaagggacaaactaaatttggaaataactttctagttgtaaaaggctcttctctcaatttcccatccattcttctgaagtctcagtaaaacaaaaccaaaccaaagcacctgatgaccctgaagtgttggctggttgtccatatgtgctaacaccactgcctgcggagctggacttttgttcttgaaagaagcaaaatgaggctttcctagctcacatcatagtcagagcctggggacatcctagcaggtgaacagtcccctacagcatggactctgctcttccagcgtacaagcagagacctccccttccatccccactagtctgttctcagggctgtctgaggctcactgtgtcccaggaacaaggcactcaaatatgaaatgctgcctgaggacacaggtcagggaattccagatatagtgctgacctggctcagtcctgggtacctgcatttcagtggaaatgtcaggagatgggattacgtctgagggtaactgtggacctgaggccggtaaacctctatgtaggacatgagagagtcaaggggaggctccaccatggctgaggcaaggctgaggctgctccttggccatgggggaagtaggtcccagggatgtgactttcctgcagctcattccactcaggaccacggggactgctgagggtgggtttgctgatccctcagggcctgtgttctcttctcctctattgcaccattggaggttctcactgagtcaggttctagtagtgagtctgtggaacatctgggtacagatactgtttgcttcaagtgactcctccccaggaaactcttgagaaggcccccatctcaatgtcacctttttctgcatggggagcagcagaaacattgggcattccctcccagaaagagcccctaattttgtgacttaggacatcagcgattgtccctcaggggtccaagcctgattctcctgctctgggtttattcccacagcctcctggacaacttctgcgctccagcctgaggactggctggttatcagtgtcacacagctgcatcctgactccatgttaccaagggttcctattccatggggaaatgagagaaagatctgccccactcatcctctctgccccatccctcctttatccttgcctgtgaccaacaccagttcatgccaagacttttactgtcacttgtgttactgaaagcagagcaagggtgcagggatgataactccttttcttactggtctccccaatggaaacagaatcaacttgtttctagaagcaaaaggagctgcccacacatggtgggtgtggatgaggtggggatgacaagaaagaatccagccagtgtgacccagaagtccaggagccttcagcctggtcccacaggtgtcctctccttttggtgcaggtgtgctgatcatttcctgagctctgaatctgtgggaaagatgacaagaaaggagaatccagcctgtgtgacccaagacccatatgtgagagcggaagtctgacacttaagaaaacgtgggctcagcattctgagaggtctggatctggctcggcctagagctgctctagaagagaagcaagagaaatgctcagccttaggtggcccaggcacagtggtcctgtcaaaggtctgagctctctgcaacatggatatcctgcagagacatccttgggaggctgtgatcctagaatgatgtaaaaatgctaatggaagtgagcaggggatggtttatggaggaatgaggagatgggtgtggggtcagatgtggtaaggagggtgcaccctgaagaggagactgtccattgtgactcataggagaaggatgcccggggcctagggcagtgacaaaaagaggacctggaaggaccggcaccctgaagacacgtagagactggggtttggtttgtctgtgagggttcctgaggagaatcacataaaaaatccacagtcagtgtcttctgtccagggctcactgtcgcaactgttgccccttccttccagatcctctgggtgtccaggttccttagccgtggatctgctcctctctctgccctcagcctaagagctgatggggcatccaccaggaagcgcatccgtgggcagggaggaggccgtgggcagccttctcctgtatgtgagacactgctcagcctcggtgaccccctgttcattaaggtgggaggaaaggaaaacaaaattcactgtgaacatctatgcatcatcaaagaaaaagcaatgagaagaaacaggaagtgaagcccagctctaatagtttatttctacttggaaataaataaaacaatatgcctgatgtgttatataaacacaataaactttttataaaaactatgaaaattatgtaaaggagcatggcttacactaaaaggaacatttaaaataatgacacccttgaaatgcaatcccaaaacacagcatccattttatttcagttacatatacggactggttttatttaaatgcctgcaataaatctcactattttgttgtttaaatggagcatttaaaatctcattgtggccaggcgcggtggctcacgcctgtaatcccagcactttgggagtctgaggtgggctgatcacaaggtcaggagttggagaccagcctggccaacatggtgaaacccagtctctactaaaaaaatacaaaaattagccgggcatggtggcgcgtgctggtaattccagctacttggaaggctgaggcaggagaattgcttgaacctgggagatggaggttgcatttagctgagatggtgccactgcactccagcctgggcaacagaccaagactccggctcaaaataaataaataaataaacaaacaaataaataaaaaatctcattgtattgcaactgtctgatgatacattcacaagtataaatatcaacataaccatccagctgtttccctccatccacgtaaaattccccaaacaaatatttgttaagagtccagggtgtatcatgccagaactcatgcaatcataaacacaatctatttcatttttcattttgattaacagaattatcttttttcttaagattattgtttttagtttattagattctagatgtcattacagaccaaagatgaataattttcatcatcttcaagccacccccacaagactcactactgaatttgaaccataatttttccctggaaatcctagttggggtgctcgatgctaagagctatcacatatcaggctcacctgaggacagactctggtcgtcaaaccaagttaaaattttaattcttcccatgttcaaagactgaacatctttgctctttttgctcataagtgaaacactccaaagacatttgccaggatcccccacagactggcattcagtgcttggaggacagactcctaggcaagatccttggtcacagtatccggatgactatgactgcaaatctggggaagtagagggagaacaaagatttaccaggaaaaccctctgggaattcctccccagggcatcccagaggtaagagctccctttctcctcagcgcagcaggatccacagaggaagtggagccctggccaccagggaggagtcacatgagaggagaggacccggtgtccaacactggtggggaagtgagtccatggggccggtccccgctctgggcttgatcctgaaataaaaggactttgtgtagacatcacctgagtcctctacaatgtacagccaaagagccatagacagattcactcctgaggagtccagtagagcgtgaagactgccctgaggtcacaggagggagacacaggtgccaccttactgggccgggacttgggagcgggggcagtggccagaaaacagggcggggcggaggcagcggtgaatctcagaggctctggtcacctgatcacagaacggtttgccttagtctggacactagggggcgcttggggaccatttctgagaagacttggggtaatcagagcagaaccaggcacctgccctgcctgatgtcctctgctcagggctggcagctgtgtcctgtgtcctccccaccccctgggaccacaaagctccacccctgccacaccctgacatactcaagcccaggagcctgacccagggctcagggtggggtcaaaaaccggggggatctgatttgcatggatggactctccccctctcagagtatgaagagagggagagatctgggggaagctcagcttcagctgtggtagagaagacaggattcaggacaatctccagcatggccggcttccctctcctcctcaccctcctcactcactgtgcaggtgacaggatggggaccaagagaggggccctgggaagcccatggggccctgctttctcctcttgtctcctttcgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggtcccacagtgctccaggcccagggggaactgagacaagaacccccttcctcctctgtcaggagggtgagccccggcagctgctgctcaggcccggcctgtggcttctgctgctgtagcttcccccatgggtccaagggcatccagggccctgcctgagagtggaggctcctcctccccttcatcctcagagtcatgaacaggctgtccaggaaacagaacatcctgcttcctgcaacttgggacacagggtctctgcactgaagtcctggactgaggtggcaggtacagctgtgtcgtcacagacccacctctgatgggaaacctgtgtctctgtcatcctccttttcccatttccaggagtttccagagtggtgtcttcctccccctgctcctcagtgtgaatccctgtgcttcctttctctccagccaattctttttttaataaaactcctttcatgtaggaataatgcatatttaataaaccacccagatttataataggaaattagacaaatgttgacattttttgatccttgaatacatcaccaccaacacgcagctatgcaacctgtgaccaaccccagcaacccctcatgaccccttgtcatctccctccctcccttccccagtgctatcctgtgcagccacagatctgtctctgtcactattgtttgctttccattttttggaatgtatcagtgttatcagacattatcttcccatttgttctggcttttttcacactgcaaactccttttgggattcttcctgttctcgctgaattgcacccatcccatagagggctcattactacctttgagggcctttaggttgattattcctgattttgtttatttattttaaagtttgaatttatcgtccatcaaaatcaaactcttggagttatgttcatctaaggtgacaggagagtctgtgatgtcttgtcgggattcttgcttcttcatctcttgcctctcgttctgtctatattggaagaggttctcatattctatttatttacttatttatttatttgggtttttaaggatttcagtgtttttttctctttaattattaatttttttattttaataggtttttagggaatcggtggtatttggttacataaataagttctttagttgtgatttctaagatattggtgcactcatcacccaagtagcgtacagtgtacccagtgagtagtcttttatccctcaccccgcttctaccatttcctcccagtcctcaaagtccattgtatcattgttatgcctttgtgttctcatagcttatctcccacttatgggtgagaatatgccatgctttgttttcaattcctgagttactgcacttagaataacagtccccaattctatccaggttgctgggaatgccattattttgttcctttttatggctgcatagtattccatggtatgcatatatttaacatttcctttatccatttgttggtttatgggcatttgggctggttccatgttcttgcaattgcaaattgtgctgctataaacatgcgtgtgcaactatcttttttgaataatgatttctttttctctgggtacatgcctagtcccagattttgggactttgctggatcaaagggtacatctatttttagttccttaaggaatctgttttccatagtggttgtactagtttaccttcccaccaccagtgtaaaagtgttttgttttcaccacatccatgccaacatctattattggccattcttgcggtattaaggtggtattgtattgtagttttgattggtatttccctgatcattagtgatgctgttcatttttctttatgtctgttggccattcatatatcttcttttgagaatttttatttatgcctttagcctactttttgatgagattgtttagtttttttcttgataatttgtttgaattctttgtagatgctagcccttagtcattaggtggatatgtagattgtgaagattttcttccactcggtgggctgtctgttaactctgctgattatttcttttgctgtgaagaagctttttagtttaattaggtcccatctatttatctttgttcttgttgcatttgcttttgggttcttggtcatgaagtctttgcctaaaccaatgtctagaagggtttttctgatgttatcttctagaatttttattgtttcaggccttaggtttaagtctttgattcatcttgagttgatttttgtataagctgagagatgaggatccaggtttatttctttcacatttggcttgccaattatcccagcaccatttcttgaacagggtgtcctagagtatagtttgaagttaggtaacctgatgcctctggatatgctttttgttgttgttgttgtttgtttgttttttcttagtcttgctttggctatgcaggctcttttttggttccatatgaattttaggattgttttttctagttctgtgataaatgatgttggtattttgatgggaattgcattgaatttgtagattgcttttggtagtatgatcattttcacaatattgattctacccattcatgagcatgggatgtgtttttatttgtttgtgtcatctatgatttctttcagcagtgttttgtagttttctttgtagagttctttaatctccttggttaggtatattcctaagtatttttttttttgcagctatttgttaaaggggttgagttcttgatttgatattcagcttggtccctgttgttgtatttgtgtgccttaattttgtatcccgaaactttgctgaattcattcaccagttctcggagctttttgaatgagtctttaaagttttctaggtatacgatcttattataagcaaacaatgacagtttgacttcctctttaccaatttggatgcccttaatttctttctcttgtctgattgctctggctaagacttccagaactatgttgaacagaagtggtgaaagtgggcattcttgtcttgttccggttctcggaagaaatgcttttaagttttttctgttcagtataatgttggctgtgggtttgtaatagagggctttcattaccataaggtatgtctcttctatgccagttttgcagagggttttaatcatgaagtgatgatggattttatcaagtactttttctgcatcgattgagataatctgtgatttttgttcttaattctgtttatgtggtatattacatttattgactttgtatgttaaaccatccctgcatccttggtaagaaacccacttcatcatggtggactatgatttgatagctgttggattgggttagcaagtatttagtttaggatttttgcatctatgttcatcagggatattggtctgtagttttcttgttttgttatgtccttcccctcattttggttttagggtgacactggcttcatagaataatttattccctctttctccatcctgtgggttaatgtattagtattctccagagggaaagaactaatggaatatatatatatatatatatatatatatatatatatatatatatgagtttattaagtattaactcacataatcacaagtcacacaataggccatctgcagggtgaggagcaaggagagccagtccatgttccaaaactgaagagcttggagtccaatgttcaagggcaggaaggatccagcactggagaatgatgtagggtgggagactaagccaatctctctttcacatttttctgtctgcttatattctagccatgctggcatctgattagattgtgcacgcccaggttaagggcgggtctgcctatcccagcccacttactcaaatgttagtctctttggcaaaaccctcacagacacactgaggatcaatactttgtatccttcaatccaataaagttgacactcaatattaaccatcgcaattactgtcatagacttggtgccaattcttctttcaatgtctgatagaattcaaatgtgaatctgtctggtcctggacttttttcgggggttgactttttaaaattattatttcaatctcactgcttgttattggtctgttcagagtttctacatcttcctggtttaatctaggagggttgtatatattcagatatttatcaatcttctctaggtttttcagattatgtgcatattatcttttatatagtttttttgttttaattttatttagttctggtctaatctttgttatttcttttcttctgctgagtttgggtttgcattgttcttgatcctccagtttcatgaggtgtgaccttagaaggtctgtttgtgctctttcaggctttttgatgtatgtatttaatgctaaacttttcccttagcactgcctttgctgtatcctggaggttttgataggttgtatcaagatttagaactactgcaaccttactattgaccaacaggtttttaattcctaagagtgtgacctcactgaatcctgacaacagctttatgattgcttttcatgcagtaggccctggttagagaggggagtgcttgtggcctggaggtaggattctgcaatttatcaaataaaaacactggaggtcagttaaatttgaattcagtaaaacaatgacaaagaattagtatgtgttagtatctcccacacaatatttttcagttgaaatacaacttatctgggtgccctgtcgtttatctgccaactcctcacaggattcaaggcttggaagagggagtgttggggctggcctcgtcttactgatgccagttctatgagatgaacctcaaaggcagagcttctctaacacagctaccctcaagaaagcacgtcagttagcactaaatacatggtataagttcctcaatcaatagtgcctactcacttccctaattcttctttgtattattcttcaagtctgcagactcaggacctctgctggggttgctgcagccagagttctggatgagggacctcataagcctttcaaaaccagacgcagggggactactcagtccccacgcagcggggcttaagccaggggtaaataagtaagaaatggaagagctcagcatggctctccctttgtccagtgagacagcaaactccagggtccttttgatgctgaaggtgcgtgggctgagagtagggggagacccaccctgagagcccagaacttccaggacaggacttgtcagtctgaaaaggggccacactcttgagtggggaagaaggaggcatctctcgccacaggcctgcatttctggtggcttccccttcaccaaactgtgctctctgctctgatgtctatcagagaatctccttcagtgagactaagatcccaggactttactaaaaataacagcatgaaccagatagatttgtaatggtaccagaattctctgcagagcaatgagtacaaatgcagcttaacaaaggccctcacactcataactgaaaggctcagtaggtctgggtctggggcagtactgggtgctgtaggcttgtccttgaggcatctacaagtaagaacaactgggaagccatcctgctgtgaccctgtatcatctgctcactgctcactgggctcagcagctgtgtcctcacagggaaccaggttcagccaacctggccttctccaccccacctagaacatgtattccggtgactgtctggactgaggttctatgaagggactggcagacaagaagagggggctgatttgcatgaagaaaccattgcacaccctttcctttcatctaaaacccattaatggatactctggggccacccacagaagtctagcttgtctcctaaatttgagagttaggaaggagtcatttcttatcaatctacaggtagaggggccatcagcagcagagggccagagtgagggagaaactggcttcgagagactcatcaacacagccaccaactcttggacaaatggggcacttgctataacagtcaccccaagctactcacaggagcctgagcctagtcccctcaccttattgcttttgattctggtccatgcctctgttttccctggactctttgcccatgtctgagtccagggaggcaggggttgctccatctcagtcaaaatctatgtatatgtaacagctactatggcttggagcagagtccactgttgtacctatgagggcctatcctgctccaccatccccttacacaggtgacaactgctatgtttctgatggactgacccttttcccctggaagacacaaggtatttattcctttctaacacaaggcatatagtggagggggtaggggtgggtgtgaagcagagtggcttttccagatataatgcagtaaggccctggttacagaagatcatttcacaaaattccacaccctttcatgataaaaacactcaacaaactatgaatagaaggaaacttcctcaacatagtaaaggccatctatgaaaatcctacaactaacatcgcatgcaatctgaaagaccaaagatatgtttttgtaatatctatcaggatcaaagcaacaatgcacattttcaccacttctattaagacagtattggaagacctagccagagtaattaggcaagagaaagaaataaacagaataaaaattagaaataaaaagtaaaattatctctgttttcatttgatttaatgtcatatgtagaatacccttaaaagtcccacaaaagaaaactttgtcagaatgattaaatgtattcggtaatatttctgaatacaaaaatcaccatgtaaaattatctcatggctgggcatggtgactcatgcatataatcctaacactttgagaggctgaggtgggaggactgcttgtggtcaagagttcaagaacagcctgggcaacaaagcaaggccctgtctctacaaaaagagagagagagagatgaaagaagaaaggaaagaaagaaagacagaaagaaaggaggaaggaaaagaaagaaagaaagaaagaaagaaaagaaagaaggaaggaaggaagaaagaaagaaagaaagaaagaaagaaagaaagaaagaaagaaagaaagaaagaaagaaagaaaatctcttacatttcaatacttgagcaaataggaaacaacccaaaacaaaatcgggacccacacccattaggatggctttacccaaataatggaaaataataagttgtagcaaagatgtatagaaattataactgtaatgcattgctggagggactataaaatgatgcatccactgaggtggccttgatgacagttgctcagaaaactaaacatagaattaccattttatcagaattttcacttctgggcatgtgcctcaaagaattgaaagcaggatctcaaaattgtccacccttgttcgtagcagcatcattcacaatagctaaaaggtggaggcagcccaagtgtcatctaatggataaacggaatatagtatacacacacaagggaatagtattcaaccttaaaaagaaagttctgacccatgcgatggcatggatgaaccctaaagacatcatgccaacagaaataagctggtttcaaaaggacaaatgttgtctgtttgctcttatatgaggtacctagagtagtgaaatccatagagacaagaagtagaatgatgttttccaggcatgaaattttggtttgggaggatgaaaaattcctggagacgaatggtggtacgtgactgtacaacaatattactttacttaatgacactgaagcgtgtggttgaaaatggttaaaatatgtgttttgtgtttgaataatttaccactgtcaaaaacaaaaagatttatatttggtgcagttacaagaaccataaaaatatacaggactaggagagtgtgcctgagtagccaggacacccttccttctgtgccagccccacagcatcctaacagaccaatagagttggaggtacctcattacaggtgacacaaaataacatgagaaagtctgagaatggccatgatggtaggggtgggtgcctgacccagtccaggagcagcctctagtgcaactatggccaaagaaggggagatgaagctggtggcaatggtagcagcctctccagctggagagggacatctgctgtcctatgaaaatggctcatagttgatatatctggcaaagacatgtcatcctgtctacctttcatgaccaactacagttttcatagtgctttggttaagctggcatggcagtcccaaacacaggatgaatgctatagcatttattgataaatactgggagtgcatgatgaccattcagacacctgggaaaatgactaggctggataacatcgttaaaacaatgagtaaagagagagatttattcttggtaaaggacctcctggatccagggagtaaagacctgaaagaagattgcccaagatttggacttttggatcaggactttggtaaaactgatcctgtttatgacaagcaaaagcaaagcagtgccctgtctgtgagtgggaatctgaatggggcaactgaacaggaagcagcagaaaagaggaagaggagttcagtgcaaacagcaagatgagatctcagagaccaccaagaaggcccagagtgaccctttgttttctgctcagcgccttgccccttacaccttttaaaacacccatttaacaaggatggctactggtatattccaaccgagcctgagccacacacccttggtcctcagaaggttgaagactgctaggcaggagaaattattcctgaagacctctacggagcctgtttctgtgaacaggttttgttagtctaacatgattaagctctccaggtaaagatctccaatgaccagctggctgactgtggttggaaagaagggttactctatgatgcaggcctctcatggggtatggaaagggacctgggactttgaaatcatcaaggatgagttgtcaccagacaccactgccaatggggttggtctcagtcctaaggtaaccatcaatctcccttaggttatgataaacttagctattcttggcagagcaaaagggaaccaagttccacctgtccactggcaaataatactcttctagctacggatgaggacaggtcttgggattttatattaatcttcctgaaaacacagagacagccaagttattgcctgatacttacaaagataaggctttgataaaatacaagaattatttgtattttgaggaaaaagacattttggataaagcacagaagagcctaaaacagattctgcacaggcaaataatattttataaaaatggtgtcaattaatatgttgaataaaaggtatttttgagggggttgatttccagccatctcacaggaaaacaactgcatggtttgcattaactttggactgtgctgcgagtgtcctccaaaggatctcgcttactcccttatgagtgacatgggctgggatgctgtggtagagcacactctggctgatgtcttgtatctcctggagacagaagtggatggaggcacagtcctccatgggaaccctgaacaggtccctctttcttttcaaatatggactttctggggaatgatactggacggcttctgtagttgttgttgttttttgaactgtctcaaatgttttcccaaagatgctacagaacatagcctatccatttagcaagtgaaaaggctgaataagactgggagagactccctgctcatcatcattcttcttccacttccagtgactgctcatattctgtgccataagccaacagctactgatcccaagatcttgtaatccctctgtaaaactggtgctgtactgcataccttgccagctgggactttttatcttactgcattttccaggaataaataaccttgtcccaaaaacaaacatatttaaagacatttccttctgtggacactgattccatgctatctgttttccaaggaagtggtgagcccgtttctgagaacacctggtatcaatggctgtcccttccaaaccaagcaaaaagtgatttcttgtcggtgtggatttggttttgttattaattttaaaacatacctttgaagacttagatctctgaaactactagatctctagaagtgtaattgtgaaaaaagtttgcttgcatcatcaacaacatgaaaaactctttctaaataaaatttgttttgaagttaaaaaaaagaataatgcaagattggaaactgggaggtctgaagattcccaagagcactctcaattctgaagctaattttcagctcagggaccccaaacagcccttcacttcttatgagtccctagaaggactcacatgactcactgaaaactgtgacattcattaatgtgatttttctacagtgaaataatacagattaaaataattcaaggaaagagacacatgggcagagttcaggagaattccaagcacaagcatccatttgtcctctcccagtggagtaatagacaacgctgcattctgccggcaacaatgtgtgattctatgtaggaagcattgccaaccagcaaagctcacccaggcttggtgtccagaaaaattttgattggtggggtgggtgagagtggggttgttatgtagaccttgatgaccatcctcatggctcacttgagtttccactgaattgacaataaaacttcaatcttcaacctttggtcattttcttttaaaaaattttctaaagaaaattattttaaaaagtctcatataaacgagctgtttatccaatatgaggctcaacgcaaatagtttcaaaaagtcagtaggtcattaaaacaattatttagtcattcaaactaaatatttagtcattcaaacgttgttatctggtgttcagatagcaacgaacaccatgtagcactaaaatcgcattatagtcacaggggcaggatttcagcaacagcaagagaaagtaatacaaacaggaatgagcaaagaatagacaagtaatgggtatgaattggcctgggaaatattgtggcaatgtccaaagacaaatcaatagttatttgttaaagaagtgaaagacaacacattctcagtccaggaaagccaccagggggtggtctgggtctcttggattgtaagaagctcaagaggttcaaacttaatgaaccctgcacagatgctcactgactcatggaaatgttagagcagctgcttcctcccacaggacaaatccacagcacacagccaccctgggctggccccccacagtgtagctgctctcagggctgtggacccaggtggtgataaaggcagtaaagatttgcataaagcagcacacagcacaccccctccgtgcggagagctcaataggagataaagagccatcagaatccagccccagctctggcaccaggggtcccttccaatatcagcaccatggcctggactcctctctttctgttcctcctcacttgctgcccaggttaagagagatttcaaataccagcctttggagggatccctttttctccctttctaattcctaatatatgtctgttttttttgtttcagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcggcacagtgacagacccatgagaggaaccaagacataaacctccctcggcccttgtgatgtggagatcacatgatcagacatgccagatcccaagatagcctacatgtggaccagccatagaaaggggaaggaaagggtttgaattgattcctatttctacttaagtcttgatgtgtaggaaatgtaagaatgatttgggagtaactggatcaaaaaaaaaaaaggaaaagttaattgttttctattctaaaaggaacactaacagcaggatcacatataaaggctgggtcaaaatgcatttcctccagaaagaagcatcttcagtgtataggctttctgagctaagagcaaagaaactttttttgcatattactgaagtttgttttattgagttactttcaaaccaatacctccagaaagaagcatcttcagtgtataggctttctgagctaagagcaaagagaagaaactctttttttgtatatgactaaaatttgctttattgatttactttcaaaccaatacatgcctattatataaaataaaaatattaaaaaccaccaagttcactgcaaagctgtctcatcagaaacaatccaatttcttcatttggatgcattctttcatttttgttctcaatatttccacaatgggggtcataccttgtgctttttctctctggttttacacatctttatgcctcctcccacaccctgtgcctctctcctgactctcagggtcctgggcagtcagggctcacttggtagcctgcacagtctgtctgtgacaaaaccagtcaccatctcctgcactggaatcagcagcaataaggttcttggaattgtgtcctggtaccaacaatgacaaggaagtgcctccaaacttctgatgtatagaagcaaatatctgcctgcagggacccaggatggatgctcgggctaccagtttggcaaggaggccttcccaagcatctctgggctccaggctgaggacaacgctgatctcaactgttggcttcagacagccccctggaggcccaaacagtgctgcagtctgggggagtgagacaggaacatgtcaggtctcctaggagcacgacctaactacagcaccatacaaccaggacagcagggctgtttaccatttgtgtgcatgtttgctggtgcttctgctaaccaggacccagggctcagattagggacagtgatctagagaatgctgctttgttttctcagggccagacttcagagagagcccttggccacagcattgtcagactgcctcagaagaatcagaaagtccttgatttctggaacaggctgccctgggaatacagccatgataggccagggcaagcagggacagaatccagctgggtctgtctcaggcatgtgcactaataaagatctctgtttgtccttattgtttactgaatacctactatgtgccaggctcaggtctcatgctaaggatacagaggtgagaagacagacagggattctgtcttcacaggactgacaccatgcagaaaagtgagggccaacaagtcaataggagtaaggcatattgtggtgtatccaagaggtgacactggccagaagggggagagcaataggaagcccttagggagttgtaagcaaggaagacacggagtctgatgggagacttaggagaaaagtccagcttctccaaagaagatgaaaaaggaggggagagagtgaaagtggagggtctaattaggagacggtagctttctccacatgagagatgaggtctccagcaagtgatgaagcagctgaggtggtgaaatatgcgtgacccacaccatggtgagtaagaccaaaggaaagaggtcactaggttgaggcccaaagcttgttcctgtgatataaacctgacaacatcctcttgccgttactgagtgtctcacacaccttttttctttggatatctcctgggactcaggactcattgctgcccttccctcgtattcagtgagattcatttcgaacatcacttttcacacccagagagagacctggctcctttgtatggagcaaaagcactgagggtcaggacagaacattctacagaacatgggatgatgccttacacactaaaggactgctgttaaagctcgtgatcaaacctccctggagctacatcagaaaccacgagaggggaggtgtcagcgcttaggtgcctgatttcagggcacactaatttgcagtttgtccagctccctcccaggcatttttatccacccctctctttacctcctttcatccttgcctccttctcagggcgggcctccaggcctgtggtgtctctgctgctctgtctccatcacaaacagagcagtagggagattatctgataatgaagttccctcctcatactcagttatctggttccccttaggaattcttctgcatcatgggaatgttctgttttatttctgccctacagtaggaacccagccatttgtgaggccaaggagattgacctctttccgttgaagcaggattatatttaacacatgtattcaaataacatcatcaacttatgaacaagtcaatccattcttcagaattatagaaatgcatgtctctcagctgtcagcaattggcctcagatccctagattggcgaacttgtcagggtggggtcagccacatgaagatgtttctttatagttagtgactctattcactgggtttcccctgttgagatccaacctccatgagactgtttatttttgttgttgttttctgtcttgtcattgcccaaaatgctgcctggcactaaggaaagacttaatacatgtttattaaatatgtgagttcacctacattggaatcccaaaaagaggtacagatctgaggtcaagttaataatttttaaaaaaattctggatattttgtgtttgagattccaagttcattcaatagaagatattaagtatgaagttttgcctttggatttggttagcaggagaaggatatggatatgaaaatacaaatggatcacacatacctccccatggcccagagtcttgagtgcctagctgctctctgcagctcctaatcacagcctctgttcactcatttatggtctgattcccatggatccatacatgctggatcccatgggcttatgtggagaaagtggagagaaggtgatggccctgctaaaaaaaccacaggaagcaagttgataatgaagcaaattctgggcacaaaatctctcaagagcaaataaactgcagaatatgggtgagttgggaaaatttctggcaatatttatataactaagaaggtttacattacatatacttcaacaaaatattaattctaaagcttccaataagtcatatgatcaatgcaattcaaacattaaactcatcagtcccaagtcccataatagactttgatggagaaattcttgaaggaagaatgatgggtttgtgagctctgtgtccacagaagagatatttctgcactaggaggactgggtaaagccattaaataattatgaatgtagtgcccatctggacttttttctaatccaatatgcaatgctgtgggctctgcctttgcaaatcgtagcattcattgtacttcctccagtctcccaattattacaataaattaattttaaacatgaatgattaaaagacaaatctattaatgttagagtccttggaatctgttgctttaatgcacaagaattatggaacacttcaaatgtatatatttgttaatttatgtaccaatgataaaatactgcttccttgatctgttctaaaaatcacctagaaagggagtaagttgatgggtaaaatgggttgaaaaattaaacaagatgaaccatattgatgatggtcaaagttggctgattggtgcaaacaattcatcagaaaattctctgtatatttgtatgactcaaacgtttccatgctaaccagtgaaaatatccttttttgcaatgagatgtttatgttctgcttttaccaggtgtacaatgtggacaaaatgtaagcttacactttgacttcaagtggaagcccatcttctcccaacaggcagaggagaagctggtgtggagaacatggaaaacacaggagctcagggtttcccaggacagagaagtgagtgagcctggagccctaaaagcaagggcaggggctgtgagttgggctgtgggggtgttctggggccacaatgtgaagggcatgttgctgaggtctcagggttcaggtttcataataacaacgaggagttactcaaggggcttaaaccagggagtgccctgcctgccctatctgagtgacagggatctctctgaatgccttgagaagagagtgtctgagaaaagtgagtgatcctgattctagattattcgctaaagcacctcgtgagtctagaaactcaggggccatttgcacagttagcacaagagtagatgtggctaaattgagaagtgatggtctctgcttttgtctcctgagacatccaactcatttgcaagagaattttgcaggtaaaatacatactgatctttctaataaactgaaaacacctagtaaaaaaatacacgtggtaatagcacaatgcaatttgtataacagctagaacaaattcttgaccaaaaaatatgatgcaactgtgcagaaaatgacgttttacttagggagataatggctaatttcataaaatagtgaaatatgtcacactgttcactggtaaaggtaagtctagcaaatctattagttttcctgtatcacaaaatcgaatcaaatctctttaaaacgtatgaaaccattgtaaatataacttgtgttgcattgctgtctttttttttttttttttttttttttagacagaatctcgctttgtcgcccaggctggggtgcagtggcccaatatcagctcactgcaagctccacctcccgggttcccgggttcacgccattctcctgcatcagcctcccgagtagctgggactacaggcgcctgccaccacgcccagctaatatgttgtatttttagtagagacggggtttcaccgcgttagccaggatggtcttgatctactgacctcgtgatccgcccgccttggcttcccaaaggaattgctgcctttaacatgtcattgatcctttatttttcctggaaatttttcattattcaccatctttttgaacaaccccagctgcccttcaacccagctcctcagctgaccccttttccatgatgcccactctgatgacatatgtgggcaaatagatttttctaaaatgccctgttggggtgctgacacctataaaagttatgtatgtacaggtctgcacatcccacagaccaagactacttctgggagtgagaaatcgtagtaataatgcatagcatgatagaagcagtgtctgggaatcagaccatggatatgtgaatacagacagtgactaaagagctgcagagaccagctgggttctgaagtctctgagctttgggaaagtgtgtttcctgggaccagcgtcagatgttgtggggctgccctgtggttccgacacagctgctcagtaatgagcattcactcagagaaatccaggccttgaggctgggccctgtgctcactgatggacactcggcagctgtgtcccctctggcctggcagagttccctgagcagggacctgtgtatggtctcaacaggtgcttcctcccagggccttgcaaaaagaaaagcaagccttcctcctgctcagtctgcagagagagctgagctgcatccccaggtctcaaggaggggcccggcagtccctgggcggaaacacatttgcatgagcaacccctcctctgcaacagtgggaagaaaaggaggcctggggcagcccagtcccactgcgggggtaagaggttgtgtccaccatggcctggactcctctcctcctcctgttcctctctcactgcacaggtaggaatagacttcagagaccagggtcagccacccagcctgattctgactcttctggcaaagatccctgaaaaactttaccctggtttctgccttagcacccattaatgtctgtgtttccaggttccctctcgcaggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttctcacagtgacacacacagatggggaagtgggacaaaaacctcaccctgctctgggtcttgctctgtaccaatttttaaattttaaaataactggcctaggcacaaactatatttggaagtactttctagttgtaaaaggctcttctctcaattttctatccatttttctgaagtctcagtaaaacaaaacaaaacaaaacaaaaccacctgatgaccctgaagtgttggctggttgtccacatgtgctaacaccagtgcctgtggagctggacgtttttttcttgaaagaagcaaaatgaggctttcctagctcacatcatggtcagagcctggggacaacatagcaggtgaacagtgccctgcagcatggactctgctcttccagcgtacgggcagagacctccccttccatccccagtagtctgttctcagggctgtctgaggctcactgtgtcccaggaacaaggcactcaaatatgaaatgctgcctgaggactcaggtcagggaattctggatatagtgctgacctggctcagtcctgggtacctgcatttcagtggcaatgtcaggagatggcgttagatattagggtaactgcgggcccgatgccagtaaacctctatgtaggacatgacagaatcaaggggaggctccaccatggctgagacaagccagaggctgctccttggccatgggggaagtagatcccatggatgtgactcctgtagctcatcccactcaggaccacggggactgctgagggtgggtttcctgatccctcagggcctgactgtgttctcttctcctctcttacaccattggagcttctcactgactcaggtctagtggtgagtctgtggaatatctggatacagaaactgcccaatatttgcttcaagtgactcctccctgggaaactcttgaggaggcccccacctcaaggtcatctttttctccatggggagcagcagaaacattggccattcccatggaaatggctatgaggcctcccagagagaacccctaagtttatgacctaggacaatagtgatggtccctcaggggtcccagcctgcttctcctgatctgggtttatccacacagcctcctggagtgcctctgggctccagcctgaggacctggctggttatcagtgtcacacagctgcatcctgactccatgttaccaagggttcctgttccatgtggaaatgatagaaagatctccccactcatcctgtctccccatccctcctttatccctgcctgtgaccaacaccagttcatgccaagacttcagctgtcagttgtgttactgaaagcagagcaagggttcagggacgataactccttttcttactggtctccccagtggaaagagaatcagtttgtttcaagaagtaaaataagctgcccacacatggtgggtgaggatgaggtggaaatgacaagaaagaatccagcctggctgggcatggcagctcacacctgtaatcctagcagtttgggaggcggaggtgggtggatcacctgaggtcaggagtttgagaccagcgtgagcaacatggtgaaacatcgtctctactaaaaatacaaaaattagttgggcatggtggctggcgcctgtaatcccagctactcgagagactgaggcaggagaatcgcttgaaccagggaggtggaggttgcattgagctgagatcatgacactgcactccagcctgggcaacaggcagagactccatctcaaaaaaaaaaaaaaaaaaaaaaagaaagaaagaaagaaaagaaaaaaggaaaagaaagaatctaggcagtgtgacccagaagtccaggagccttcggcctggtcccacaggtgtcccctcctttttgaacaggtatgctggccatttgctgagctctgaaactgtgggagtgataacaagaaaggcgaatccagcctgtgtgacccacagatgtgagagaggtagtctgatgcttaagaaaaggtgggatcagccttctgaaaggtctggatctggcttggcctagagctggtgtagaagagaagcaagagagatgcttagccttgggtggcccaggcccagctgtcctgtcaaggggctgagctctctgcaacatggaaatcctgcagagccatccttgggaggctgtgatctcagtaggatgcaaaaatgctaatggaagtgagcaggggatggtttatgggggaatgaggggacggtgtggggtcaggtgtggtaaggagggtgcaccctgaagaggagagtgtccattgtgactcacaggaggaggaggcccggggcccagagcagtgacaaaaggaggacctggaaggacctgggccctcaagacacacagagactggggttttggtctgtccctgagggtccctcaggaggatcacataaaaaatccatagtcagtgtcctctgtccaaggctcactgtcccagctgttgtccctcccggatcctctgggtgtccacatcctgtagttttggacctgttcttctctctgccctcaacctaacagctgatggggcatccaccaggaagcgcatccgtgggcagggaggaggccgtgggcagccttgtcctgtatgtgagacactgctcagactcggtgaccccctgttcattaacgtgggaggaaaggaaaacaaaattcactgtgaacatctatacatcatcaaagaaaaagcaatgagaaaaaacaggaagtgaagcccagctctaatagtttatttctacttggaaataaataaaacttaatatgcctgatgtgttatgtaaatacaacaaacatattttaaaaactataaaaattatgtaaaggcacatggcttacactaaaagaaacatttaaaataacaacacccttgaaatgcaatcccaaaacacagcatacattttatttcagttccatgtatggactggttttatttaaatgtctgtattaggtttcactatttggttgtttaaatggagcatttaaaatcttattgtattacaacttatatcaacataatcatcttgctgtttttctgtatccccttaaaattccctaaacaaatatttattaagagcccagggtgtatcatgccagaactcaggcagtcacagacataacctgtttcatttttcattttgatcaacagaattatgttttctgttaagcttgttgtttttagttcattagattctagacgtcattacagatcaaagacgaaaaatttctatcatctttaagccacccccacaacactcactactgaatttgaaccaaaatcttctcctagaaatcctcgttggcggctcgatagtaagagctgccatgtatcaggctcacctgaggacagacgctggttaaaccaagttgaagttttaattcttcccatcttcaaagactgagcatctttgctctttttgctcataagtgaaacactccaaagtcatttgccaggatcccctgtagatgggcattcagtgtacagactcctaggcaagatccctggtcacagtatccaaatgactttgactgcaaacctggggaagtagagagagaacaaagatttaccagaaaaaccctctgggaatgtcttcccaaggcaccctagagggaagagctccctttctcttcagctccacaggatccacagaggaaggagagctctagccagcaggaaggagccacatgagaggagaggaccaggtgtcccacacaggtggggaagtgagtccatggggctggtccccgctctgggcttgatcctgacataagaggactctgtgtagacaccacctgagtcctctgcaatgtacagccacagagccatggacagattcactcctgaggagtccagtagagcgcgaagactgccttgaggtcacagcgggaagacacaggtgtcacttgagctggcctggacctgagagagggggcagtggacagaacagaggggaggcagtggtgtgaatgagaggctctggtcaccttatcatagaatggtttaccttggctggacaccaggggacgctgggggaccatttctgagaagacgcgcggggggcgggggtgggcggtgatgggagcacaaccggccacctgttgtgcctgttgtcctctgctcagggctcacaactgtgttctccccaccctctgggaccacagagctccacccctgccacaccctgacatcctcaaggcaaggagcctgacccagggctcagggtggggtcacaaagctgggggggtctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcaggtgacaggatggggaccaagaaaggggccctgggaagcccatggggccctgctttctcctcttgtctccttttgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcccacagtgctccaggccaatagggaactgagacaagaacccccttcctcctctgtcaggagggtgagccccagcagctgctgctcaggcctggcctgtggcttctgctgctgcagcttccttcatgggtccaggggcatccagggccctgcctgagagtggaggctcctcctccccttcagtcctcagagtcaggaacaggacatccaggaaacagaacatcctcctccctgcagcttaggacacagggtctctgcactgaagtcctgggctgaggtggcaggtccagttgtgtcatctcagacccacctctgatggggaacccgtgtctccgtcatcctccttttcccatttccaggagtttccagagtggtgtcttcctccccctgctcctcagtgtgaatccctgtgcttcctttctctccagcctattcttttttaataaaactcctttcatgtaggaactatgcacatctaataaactacccatatttataacaggaaattagacaaattttggcatttttctggttccttgaaaacatcaccatccccgggagctattgtgaccatcccggcagctcctcatgatgcttgtctcctccctccctcccctaatggcctctcaggaagccacagatctgcctctctcactactgtttggtttttttttctggaatgtatcagtgttatcaaacgttatcttcccatttgttcaggcttctttcactctgcacacttgctttgagattatccctgctgtcgctgaattgcacccatcccttagagggctcattactatctttaagggtccttaggccatttttttctgattttattcatgtatttcctttaaagtttgaatttattgttcatcaaacaaactctatgggtgatgttcatctaaggtgacaggacagtccgtgatggtttgtcaggattcttgcttcttcagttcttttcttggctctctctatagtggaagaggttctcatcttttatttatttatttatttattttggggtttttttaagggttttagcgattttccctttttaattatttttaaaatttgttattttattttaataggtttttggagaacaagtgttgcttggttacatatataagttcgttagtggtgattcctgagattgtggtgcactcatcatccaagcagtgtacactgtatccaatgagtagcctctcatccctcacctccctcctatgctttcccccgagtccccaaagtccattgtatcattgttatgcccttgggttctcatagcttatctcccacttatgagtgagaacatacagtgttttgttttccattcctgagttacaccagttagaatgatagtctccagttccatccaggttgctgtgaatgccattattttgtttatttttatggctgtgtagtattccctggtatgtgtatgtatacatcacatttgctttacctacttgttgatttatggacatttgagctggttccatgtttttgcaattacagattgtgctgctataaacatgcgtgtgcaagtatctttttttgtataatgacttctttttctctgggtagatacctagtcgtgagattgctggatcaaagggtacgtctatttttgtttccttaaggaatctccacactgttttccacagtgattgtactagtttaccttcccaccgccagtgtgaaagtgttttgttttcaccacatccatgccaacatctgttatttttttattatagctattcttgtgataggaaggtggtaacacagattgtggtaccgatttgcatttccctgattattagtgatgttgaacatttttctatatgtttgttggccatttgtacaagttcttttgaaaattgtttattcgtgtccttagtccaccttttgatggaagtgtttatttttttcttgataatttgagttcttcgtacattctagatattagtcatttgttggatgtatagattgtgaagattttcatccactttgttggttgtctgttaactctgctgattctttcttttgctgtgcagaagtttttttcgtttaattaagtcccatctatttatctttgttcttgttgcatttgcttttgtgttcttggtcatgaaatatttgcctaaaccaatgtctagcaaggttgttctgacgttatcttctagaattcttaccgtttcaggccttagatttaattatttgattcatcttgagttgatttttgtataaggtgagagatgaggatgcagtttcattcctctacatttggcttgccaattatcccagcaccatttgttgaatatggtgtcatttttctactttatgtttttgtttgctttgtcaagcatcagtgggttggaagtatttggtttcatttctggattctttattctgttcctttggtctgtgtgcccatttttatatcagtaccaagcagatttagtgactatggagtcaaactttactggagtttgaagctgggtaatgcgatgcctccagatttgttccttttgcttagtcttgctttgtctatgcaggctctttttggttccatatgaattttaggattattttttccaattctctaatgaatgatggtgatattttgatgggaattgcatagattttgtaacttgcttttggcagtatgatcattttcaatgtattgtttctacccattcatgagcatgggatgtgtttctatttgtttgtgtgtgtcatctatgatttctttcagcagtgttttgtagttttccttgtggaggtctttcacctccttggctaggtatatcctaagtatgtattttgcagctatttgcgaaaggggttgagttcttgatttgattttcagctcgtttgctgtcattgtataacagagctactgattcgtgtgccttaattttgtatcttgaaactttgctgaacttatttacagttctaggagctttttcgatgagtctttaaggttttctaggtatatgatcatattatcagcaaatagtgacagtttgaattcctctttgtcaatttggatatctttgatttgtttctcttgtctgattgctctggctaagccttccagtactatgttgaatagaagtggtgaaagtgggcattcttgccttgttccagatctcaggagaaacgttttccacttttttccgtttaatataatgttgactgtgtgtttgtaatagagggcttaatagaggacataagttatgtcttttctatgtcaattttgcaaagagttttaatcatgaagtgatgctggattttgtcaagtattttttctgcatgtattgagataatcatgtcatttttgtttttaatgctttttatgtggtatatcacatttattgactcacatatgttaaaccatctctgcattccctggtttgaaaaccacttgatcattgtggactatgtttttgatagctgttggatacatagaataatttaggaaggagtccccctttttccttcctgtggattaatgcattagtcagcgttctctagagggacacaaataatggaatatatatatatgtttattaagtattaactcacatgaacacaaggtccaacaataggctgtctgcaggctgaggagcaaggagagccagtccgagttccaaaactgaagaagttggagttccatatttgaaggcaggaagcatccagcatgggagaaagatgtaggctgggaggctatgcccatctctcttttcatatttttctacctgcttattttctagccatgctgtcagctgattagattgttcccacccagattaagggtgagtgtggctttcccacccactgacaaaaatgtgaatctcctttggcagcaccctcaacagacacacacaccaaggatcaatacttttttttttttttttttggagatggagtcttgctctgtcacccaagctggagtgcagtggcgcgatctctgctcactgcaagctccgcctccagggttcaagcaattctttgcctcagcctcccgagtagctgggactacaggtgcccaccaccatggccggctaatttttttgaatttttagtagagacggggtttcaccgtgttagccaggatggtctcgatctcctgacctcgtgatccgcctgcctcggcctcccaaagtgctgggattacaggcgtgagccactgcgcccggccaatactttttgtccttcaatccaatcaagttgacgctcagtattactcatcacaagtccactccttgtcagcatgaacccatatacaacttgtgatatcgtacataatcttcaaataaagacaataataaagtcataattacgcctaacataatacaattatccttcatacaaccagaacgcacgaatccctaacacaaatactattacatcaagttactgatacttaaatgctgatgtgacgtcaataaatcttatgttatatgacaaaggagaaaggaaataaaatgaagatattttcttagtacgagtttatagatgcgcaaacatgtttttaacaaaagaaggaggaaatactcttgacaattacactcctcgtttctgccgctggccatagctggtattgatgactaccttcttctactacccattctgtattccctttgccttcagcaagcacctcagtaggttgtgttttttttcctggtggagtgacccaaatcttcattcctgaagggtcccattgaccttaatcacagggcatggtaatagcaagaaatgccctaatgcatctcctgtattccatgcatgttcttcagtaactccattgtggagtagtaaactgatttcattttgatagtctgggtcaatcaccccagccgacactgtaactcccttcttagccattgacttaaaggtaggagaagcccaaaatgtccaggtggcaatcttaacttccagtttaatggaatcattgttgtgtctccaggtggtagtgttccttcctctggaagtaaatcctttgagccagcagaacataatgtctcaggaacaggaagcaaaacatttgctagtggatcactagggttgatggtgagtggtgccacttccacttccaccccttgattcctggatccatgaatcctggctacaggagggacagtaccatatattggatgctgatttaaagcatacacagccatctggagaactttgccctggccctgcaaagtattgtcacctagttggcaatgtaattgtgacttcaaaagccattccactgttctatcaatccagctgtttcaggatgatggggaacatggtaagaccagtgaattttgtgagcttgagcccactgctgcacttctttagtcataaagtgagagcctttgtcagagcattgttgtgtggaatatgatgacagtgaatgaggcattccaagagtacacggatggtagtctcataggcaaaccaatatctaggataagtgtctatttcagttaagacaaacctctgcccttcctgtgatggaagaggtctgttgtatttctcctcacacagggcaccagttgagatattgctcctcagaagacagcattagctgcgggggtctgcctgcagaccctgactcaaacgacggatgaataaaaacggacactgacacacagatattctgtttggccagtccggctgggttctttgattctgagtgtccgacaacatacacaccaggagaggtttgtcactgtggtgggtcctgagcagctggtactccaggcatttatttagtatacaattaacaacagaagctttgagtaaacacacttgtggataattaacatggttaagagagtagttctacgaatgattaaagctcaggtaccctggtctaaagtaaataccattacggggcaatatccctggttgacctcccaccgagagggccatctggctcaaaggttagttaatggagatagggtaaacaggcttaactgggaaagcctccattgtccctagcatttaccctatgacctaatgctctaaggtaagaaccagctgccttcagcctgtacaattattacaagctatgtaacattttagccttccaaaatgtttgtgattattccctataactttccctaatatttccctttgatatttctgccaccatcctgagtgaatcccaacagaggtccaatataatcaacctgccaccaggtagctggctgataaccccaaggaatggtgccacatcaagggctcagtgttggtctctgctgctggcaaattgggcactcagcagtggctgtagctaggtcagccttggtgagtggaagtccatgttgatgagcccgtgtgtaacctccattcctgccagcatggccacttccctcatgggcccattgggcgatgacaggggtgtctggggaaagaggatgcgtggtgttcacagaactggtcatactctcctcttgattattaaaatcctcctctgctgaggtcacccgttggtgagcgctcacatgggatacaaatactttcacagtttttgaccactcagagaggtccatccacatatcttttccccaaatttctttgtcatcaattttccaatcatacttcttcctagtccctgtgacagttactacaggacagaatgaagggggactaacacagaaatgaagacaaagacaaagggatctgttttaaagaaggggtcagggggctccttgcttctagtgagcaagggccctgagctactgcaatccttcatatttattaggtagaaagaacagggaggaggaggtaacagttggtcagctgcttgatttatcacaggttcacaggattgctttctttatacaacatacttcagatgtgctgcagataatcaaaagaaacactgtgcttggggcgtgacggctctcagcattcgttctggtggtagatgcagtttgtcgtttgccaacaacctgcattcatgagaacagcttgctgtttgctccagtggtatactgagttggtcacgaccctcattctttcggcctccaagaagtccctgatcgtccagccaaaccgttgactacagcaaataaattcatatataatcacacatctggagatttctccttccatgcaaagagcacaaccaggtgtgctcctcaaagttctgcccaatgggaagatttcccttcaccgctgtacttcagggatgtcctggaaaggggctgtagtgctgcagctgtccactttccggtggtgcctgcatatcatgcagatacatttgtgaaccaggccctagtcttctttctgtcagctgatcatagtgaactgcccctgagaccaccagtgcaggctgggggatagtgcaggctggtggcaggagtggaggtcatggacatttgagccacttccccatgtaacttacttgtgccttcagcccaaatacgtatataccacttccactgaatgatggaatgctgctgtgcatgatccactttatggctaaatgggttagaaagcacccacttcatgacaggcagttcaggttgcgtggggactttaagacgcatagtcaaatgttcagtttccaccaaagcccagtaataggccaagagctgtctctcaaaaagagagtagctacctgcagaagatggcagggccttgcaccaaaatcctagaggcctccactgtgattcacttacagtggcctgacaaagactccaagtagctttgctatctgccgctgacacccaaataccattgggtctgttgggtcatacggcccaagtggcagagcagcttgcacagcagcctggacctgttgcagagccttctcctgttctgaatcccactcaaacctggcagccttttgggttacttgataaatggactggagtaacacacccaaattagagatatgttgcctccaaaatccaaataggcccactagccattgtgcctttcttggttgtaggaggggctaaatgcagcaacttatccttcaccttagaaggaatgcctcgacaggccccacaccactggacacctagaaattttattgaggtagaatgcccttgaattttagttggatttaccgcccatcctcttgcatgcaaatgtctcaccagtaagtccactgtgtttgctacttcttgcccactggatgcaaccagcacaatgtcatcaatttaatgggtcagtgttatatcttgcaaaagagacaagcaatcaaaatttctttgaataagattatgacacacagctggagagctcatatacccctgaggtaggaccgtaaaagtatattgctggccttgcctgctgaacgcaaattgcttctggtgggccttatggaccggaatggagaaaaaggcattttccaagtcaatggctgcatatgaggtgccaggagatgcattaatttgctcaaacaaggaaaccacatctggtacagcagctgcgattggagtcaccacttggttaaacttccgataatccactgtaattctccaagatccatctatcttctgcacaggccaaatgggagagttgaaaggggatgttgtgagaatcaccacccctgcatttttcaagtccttgatggtatcactaatctctgcaatccctccacagatgcaatattgtgggtttatttttttttaataaagtttcactctgttgcccaggctaaactacgatggcagaatcatggctcactgaaacctccatctctggtttcaagcaattctcctgcctcagcctcccaagtagctgggattacaggtatgtaccatcacaccccacgaattttttgtatttagtgtagatgaggtttcaccatgttggtcaggctggtctcgaactcctgacctcaggtgaggtgatccacactaagatccagcttatgtggatcttttctcttcttttcttggttaatctcactagtggtatatataattttatttatcttgtctaagaattggtttttgtttcatttatcttttctatcatttttttgtttcaattttatttagttctggtctgatattgctatttcctctcttctgctgggtttgggtttgcattgttcttgattctccatttccatgaggtgtaaccttagattgtctgtttgtgctctttcagactttgtgatgtacgtatttaattctaaacattcctcatagcactgcttttgctgtatcccagaggttttgataggttttatcaagatttagtacaactgcaaccttactattggccaacggcttttgaattcctaagagtgtgacctcatttaatcctgacaacagctttatgattgcttttcattcagtaggtcgtgattagagagggagtgcttgtggcctggatggaaggttctccagtttatcaaataaaaacaccgaaggtcagttaaatttgaattcagtaaaacaatgacaaagaattagtatgtgtaactcccacacaatattgttcatttgagatacaaacttaccttgtagttcatctgccaactgcacacagggttcaaagcctggaagaggcagagttagagctggtcttctcttcctgatgccaggtctatgagctgaacctcaaagacagggcttctctaacacagctaccctcaagtaagcacatcggttagcactaaatacacagtatacgatgcccaatcaataatgcctactcacttttctaattcttctttctattattcttcaaatctgcagactcaagacctcccgaaacattgcggcagccaggattttgaatgagggtcctcatatgtctttccaaacaagatgcaagggtgctccttggtccctacacagaggggcttaagccaggagtgcataagtaacatgtaagagacagaagaactcaacctggctctccctctgtgcagtgaaacacctaattccagggttctttgattctgaaggtgggtgggctgagagaaagaggagccccaccctgagagctccgagtattcaggacaagacttggcagcctgaataggggctatactcttgagtgtggaagaagcaggcatctctgggcacaggctgcttttctggtggcttctccttcaccaaactgggctccctgctgtgatgtctatcagagaatctccttcagtaagaccaagattccaggatttaactaaaaatagcagcacagaccagaaaggtatgtcatggtacttgaattctgtgcagagcaataagtacaaatgcagcttaacaggggccttcagagttgtatctttggtgaaggagaaaatagacaatggcagggagaaactgaaggactcagtaggtctggaactggggcagcactgggtgctataagcttgtccttcaggggtctacagatgctgacacctgggaagtcatcctgcatcatctgctcactgctcactgggctcagcagctatgtcctcacaaataaccagattcaatcaacctggccttctccacccaacctggggaatgtattccagtgactgtttcaactgaggttctatgaaggggttgggggataagaagaggggactgatttgcttgaagaaaccattgcacaccctttcctttcatctaaaacctattaatggaaactctgaggccacccatagaagtctagctggtcttctaaatttgggagttacgaaggagtcattcctgatcaatctacaggataaggggccatcagcagctggtggtcagagtgaggaagaaaatggcttccttgagagactcatcagcacagccaccaactctggggaaaatggggcacttgctataacagtcaccccaaactactcacaggagcctgagcctcgtcccctcaccttattgtttctgattctggtccatgcctctgttttccctggacccctcgcccatgtctgagtccagggtagcaggggtagttccatcccagtcaacatctatacagaagtaacagctgctatggcttgaagccgagtctacagttctacccatgagggcctctttttctccccaatcccctcacacaggtgaccagtgctgtgggtctggtggagtggccactggccactggtcccaggcgaacacaaagtatttattcctctctaacaccaggcatatattggagggggtttggtgggtgtagaacagagtggttcttccagatgcaaagcagtaagaccctgtctacagaaagtcatttcacaaacctccacaccctttcatgataaaaacgctcagtgaactatgaatacaaagaaactaccctaacatagtaaaagctatctatgaaaatcccacagtcaacatcacacataatcttaaagaccaaagatatgtttttgtaatatcaggaacatagcaacaatgtacacttcactgcttctattcaaaacagtattgaaagtcctagccacagcaataaggcaagagaaataaataaacaggataacaattagaaataaaaagtaaaactatctctgttttcaatggatttaatgtcatatgtagaatacccttaaaagttccacaaaacagcttttgtcagaatgattaaatgtattctgtaatgttcagaatacaaaatcaccatgtaaaaacacctcatggctgggcatggtgactcacgcctataatcctggcactttgagaggctgaggtgggaggattacttgggatcaagagttcaaggacagcctgggctacaaagcaagagcctgtctcaagaagaaaaacgaaagaaagagagaaacaaagaaagagatagaaagaaagaaagaagaaagaaaatctcttatatttcaatacttagaaaatctcttatatttcaatatttaaacaaggacacaggaaaaaacccaaaacaaaattaataaaacaaatcaaattgcaacatcattagagagagtaaaatatggctgggcacagtagctcatgcctgcaatctcagcactttgggaggctgatttggacggatcatctgaggttagaagttcaagaccagcctcaacaatatggtaaagcctcgttcctacaagataaaataaaataaaattgctagctgtggtggcacatgcctgtaatcccagctactcaggggtccaagtcacaagaattgcttcagcctaggagggagaggttgcagtgagccaagatcttgccactgtactccagcctgggtgacagtgagacattgtctcaaagaaacaaataaataaaaatgaaacagtaaaatacttaagaataaagttattcaaagaggtgaaagacttgtagattgaaaagtataaaacattactaaaagaaattaaagaatacacaaataaatggaaagaaatcctttgttcatatactggaaaactcagtattgttatgctaacaaaacaaaccaggaggaattgacagattcatttcaatctctgaaaacattccagtaatattttatgcaagaatagaaaaaaattaaacctaaaatatatatagagtatgaagggaacctaaacagtcaaagtcatcttgtaaaagaagaccagtgttggaggtctcacactttctgatttcaaaacatactacaaagctacactaatcaaaacagagtggtatatatgtaacatacatactgacaaataaaatagaactgagtgcctagaaaaaaaactcttagttatacagtcaaataattttaaacaaggttgtcaagacttttcagtggaaacagtacagtctttcacaaatatagacgttctgggaaataatactgaatggcttttgctgttgttgtttttgaatggtctcaaatgttctctcaaagatgctgcagaacatagcttattgattttgtaagttaaaaggctgagtaagactgtgagagactccctgctcatcatcattcttcttccacttccagtgactactcttatattctgtgccataagccaacagctactgaccccaggatcttttaatccttctgtaaaactgtcattaaaaaaaaattgtctaaagtaaattttttaaaaaattctcacttaaaccagctgtttatccaatataaggctcaacacaaatagttacagaaagccagtaggtcattaaaacaattaatttagtcattcaaataaaaatgaacaccatgtaacactaatatcaaattatagtcacaggggcaggatttcagcaacagcaagagaaagtagcacaaataggaatgagcaaagaatagacaattaatgagtgtgaattggcctggaaaatattgtggcaatgtccaaagataaatccacagttatttgtgaaacaagtgaaagaccacgcattctcagtccaggaaagccaccagggggtggtctgggtctcttgaactgtaagaagctcaagaggtccaaacttcatgaaccctgcacaggtgctcattgactcatgtaaacgttagagcagctgcttcctcccacaggacaaatccacagcacacagcctccctgggctggcccctcacagtgtagctgctctcaggcctgtggacccaggtggtgataaaggcagtaaagatttgcataaagcagcacacagcacaccccctccatggagagagctcaataggagataaagagccatcagaatccagccccagctctggcgccaggggtcccttccaatatcagcaccatggcctggactcctctctttctgttcctcctcacttgctgcccaggttaagagagatttcaaataccagcctttggagggatccttctgtctgcccttctaatttctaacatgtgtctgttttttgtttcagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcagcacagtgacagactcataagaggaaccaagacataaacctccctcggcccttgtgatgtggagattgtgtgatcatacacaccagctctcaagacagcctacatgtggaccagccatagaaaggggaaggaaagggtctgaattgatttctatccctccttgtgccctgaagtggaggaaatgtgagagtgatttgcagtaattgaatgagacaaagcaaaagttatttgttttatatgaaaaaaaaaaacagaaacagcaggatcagatctaaaggctgagtctaaatgcatttcctccagacagaagcttcttcaaacgatgggctttctgagctaagagcaaagaaaataaactctccacgggtatattattaaagtttattttattgagttactttcaaagcaatccatgactattatataaagtcagaaagtattaaaaatcaccaagttctctgctaagctaccttatcccatgcaatcaaaataagtacttttcttcatttggatgcattttttatttctgtttttaatatttccacaatggtgattaaacctggtgctcattcctctggtttgatccacctttatgctcttgtcatttaaagttaatgtaagtagtgttccatttatttaaaaggataaaatattttaatagttgatcattgcattttgaactgagtaccagtgaagtattctagcttttaggtaatttcaattgtttgctagtcaatgatgttatacgttgttgtcattaaaccattcctggtcatttctgtggattttgtgaggtcagagaaaatgtctgtgcttttcaatggaaagccttgggtacattattcctgacttcccaacgcacaaaatagagaaacacaaatttcctgctcatgttagttagagcataagagattcaggtacgaggaacaatttataccccaaactacatacagtgtcttcaggcatgtattagaagtgtacttctcaaactctctgatacccttagttctgaagaagctcaaagttggctaatacttttatatttatctttttattttttttacctcagccagcactttctcctgattcctggggttttctgcatttccagtgaatccagtgaatcacacaaataggctaactgattcttcccaaactccagcactctcccttatgtgctgatctagtgaggaatcacatgggaagagagacccatggatttctggcggcctgggaagtgagttcatggctggcctcagcttgcaaaccagacacttgtctccttgtttccctttactgttcattgggttcagcagctgtgtccttccaggtttcctggacagtgatggaccacactctcccaactcccaaccacccgctcctcaaaaggaataaccagactcagcaacttatgtgaggggcacagccaggggtcaggatagattggcattaagtcccctcaattaagagaggccagggaaggggggctgttccccctaatccgtgtggctcaggaagcagagctctagagacatctctaccatggcctgcaccccctcctcctcaccctcctcagtcgcggcacaggtggctggagacagggagtcagggactggcactggcaggaccagggctctgctttgctcccctggctcactgagctgcctccctcaccctgtgtctctctcccgactctcagggtcccgggcaatcatggctcatcaggtaacctgcaccgtctgtctgtggctaaaccagccaccatctcctgaactggaagcagcagcaataaggttcttggaattgtgacctggtgccaacaatgaccaggaagtgcctccaagcttctgactcatagaagtaaatatctgcccgcagggattcaggacagacgctcaggctaccagtcttgcatgaagcccttcctaagcatctctgggctttaggctgaggacaaggctgatcactcctgttggcttcagacagccccctggaggtccaaacagtgctgcagtctgggaaagtgagatgagaacacgccaggtctcctaggagcatgaccttccaatggcaccacccacaaccaggacagctggtctgtttaccatttgtgtggatgtttcttgatgctgccgctaaccagggcccaagacttagttcggggacagtgatctagagaatacagctttgttctctcacagccagccctcagaggaagcccttagcaacagcattgtcagactgcctcaaaaaaatcagtctttgattccaggaacaggctgccctggggacagactcaagatgagtcagggtaagcagggacagaatccagctgggtctgcctcaggcatgtgcactaacgcaaaggtctgttcatccttattgtctactaaacacctattatgtgccagtctcaggagagtgctcaggatacagagtttacaagacagacagggttcctgtctttacagggataatgcctcacagaagagtgagcaccaacaaatcaatgagaataaggcatattgtgaggtataaaatggttgacatgggccagaagacagtgagcaacaagaagctattaggaggttgtaagcaaggagatacagactctggtttgagattcaggaggcaaagtccagcttctctaaggaagatgaaaaaggaggggacagagtgaagaaagatggtccagttaggacatggtggctttgtacacatgagagatgaggtttctggcaagtaatgtggcagctgagctgaggcctgtgctgtggatcccagacgggagccacctgctaggcctaggctggagccctctgcctctgctcacgaggaccagcagctgtgtccttacaggtccttagggagccacagaacagccccaccctggtccaccccatcccaggctcagctttctaggcaagggtcagagtcagggcctagggtgggacttggccagcccaggggaggaggctggtgtgcatgaagagaccctccttcatcctgggctgctggcgaaagtaatagggactgggggagctcaagcccagctgagtgtcatcaggatgcagagctgtgtgtgggtccccaccaaggcctgagctcctccctttctcccccttctcattcactgcacaggtaactagggctagggatcagggctgtgggtgaatggaacgaggaccctgcatgctgccctctcaactgacccacctctctcaccctctgttagtccaggtgtcaaggttctgggcccagtctgtgctgactcagtggtgtgaagagttcctgtgggtggggtaaactgccgccatctatcacacttgaagcagaagcaaggctgggtgtgggcctgtgtcctggtatcagcagtgcccccaaactcctcatctatgacagcagtcattggtctgcacaggtcccagcgaagttctcaggtcccaggttggggatcatggcatccctgagcatctctgggctccaggcagagaatgaggctgattctttcgctcatcttgagacccaaggatccatgattaggcagtgctgcaggccagtgggtagctgggaggaaaaccttctgtctccccagtaatgtgtcttccctcttcagcctccaccccttcagcacaagtttctggggaggagggtctgaagcccgggtgagaaaaagggtcaaggctggccttaggacctggatgggcacagtgaccccctgctgagagggccttcatgagcaagaaggctgggggaggtcctgagttgatttttacaatggaaacagacaccagctccccatccttgttcaaaagcatctcaggaccttttcctctgcagatggcaagggggagaatctccctctgagatacatgagaattcccttcccatgacctgtcctgtcacctggatgaattcgtatttggaaaccaaatgactccccagtgccaggcattacatcctcacagaaaacctgccagaatgagcaagatcttccctccctgacccactggccaggaatctcggacatcaggatggctggactagatcactcatgccatctcccctgacatcatcatggttaccggggggactctctgattaatttgggccacacagtgcctgtccctggcattgcagttggggacgcttacaggctaagtttatggctgggagacctagggtctagaaaggagaggaatagaacagaagctttgcctacatggccccctgtgtgcatcactcttccctccacctttatcctaagttcatgatgggtgatgtctccttgaggctggaacctgggcagtgacatgggcctgtgtgtcctcatctcacaatgcttcatcttgggctccctgacctttctgatattcctataatggatcaatttcaggctaggacacagccatgcccatacaggaggcagtgatctgagaatcaggtagtcttagaagagacagaaagcaaataaacaccctcatgttggcctcctaagcccagaggacataaggaaatgaaaggaattcaagaagaaacataagtggtcactgcccaccatcacctgggcacctgttctccacctgcccctctctcagtgaggaccagactcagaggcctagagaaacacgtcttcatctgttcacaccgtggggtgcctccttctggactcatcccaagactgctgctcccccagcttacctgtgtaactgctgagagtcttcacagggacctggtcacagggtttgggatcaggatcagcctggctttaactcagctgtgaccctgccccttcaggacaaaaagtgaactattagggctctaactgaactctcctgatttacttaaatcttatattctccttctcaatatccttctaggaagttctgtctctacccaataatgtcaggtcatttcctcaggcctagagccatttgatttccagacttctatactcacacttatgctctcattctctgtcatggttcatttactacgcagcagctaatgaggccaaccatgtatctacagcccattgacatgaaaaatggggaggagagggttccttagataaatacagggttagcaaaggaaagtttcttaggaatcacttcaggatccaagaaaattcattccagagcttcgagagtttacaactcaaaaacaacagcataatatatgaggtggtgaatcttcttggccttctcaatgaataacctcagaaatggtcagagaatatgcttcaaaaaggtaagagtatgactttcacaaacatatagtattcacatatgtcaacaattttaattggtttatgtattttggagaaaaacagtatgatgataaataaatgttaaaaagcatttttaaaaactcagtgcttatactccaccaggatagaacctgtgaaggaaatttctgtgttgaagatacactgtcttttagaataatagcaacatagctatgaattttgtcttctcatctcacaatctacaaattaaaatcaccccatttatgtgaaatatctagaaaaatacaggtacatttggacattcccatctgccaccacccatccatcttctcctaaagtggaatccctctgcccccattctgctcctctccacacatctacctgctaacacgtgactcctccctgccttcctttccagatccctagcagattgggcccaccaggggaacaagctcttggacctggggatcaaaagtgcatcttgttggacttctgaggacttgccctgcaagggtctctttctggatcacaatccctctgttcctgggcatccccttttgctggatcctgttatttatctctgtgttactccatctaggtctactctgtggacttccctgcatcttcacctgaaccccaggaatcttcaagtcatgccaatattccctcagttctcctgaaatgtcttattttctcttctcctgagatcccaccaagtcatcccttctgagacccctgagtgtagcagggccctctctggtctctttgcttcaattatgaatgaggagaatgggaggtcctctttgccgctcctacccctgtgttgccatcaggatcagcttcatgaggcagaatgaggctgtctagatcaacatggctttcccaacattgagctctgtgcccagcacaaggtaggtgctcagtaactatttgagaaaacctacatttcatcacactggccacattacactgagtccaggatggggatgaactgggagaagcagtggtggaaatattcctctctctgctttcaggctaagaactgatgggacgttcaccagggagagcatcccttggcagaaagggggccatgggcatccttgtcctgtatgggagacactgctcagcctgggggaacctctgttcatgaaggtgggagaaaaagataaacaaaattcactgtgaatgtctatgtatcatcacagaggaggcaatgacaagaaaataggaagtgcaagcccagttacaattggtttctactttaaaagaaataaaatttaatatgcctggtgtgttatgtaaacacaacaaacatttttcgaaaactataaaaatatttaaagtaacatggtttacaataaataggaacatttgaaataatgacaccctggaaatgcaatcctaaaatacagcatacattttatttcagttatttatcttgactggttttatttaaatgtctatattagagatcactacttcattgtggatttttgtttgtttgcttgtttgttgtttttgagatagagtctagctctgtcacccaggctggagtgcagtagcacaatctcgacttattgcagtctccagctcccaggttcaagcacttctcctgcctcagcctcccacgcacctgggaccacaggtgcgcaccagtatgcctggctaatttttgtgtttttagtagagatggggtttcttttttttttttttttttttttgagaccgagtcttcctctgttgccaggctgaagttcagtggcgcaatctcggtacactgcaacctctgcctcccaggtttaagcaattgtcctgcctcagccttctgagtagctgggactacaggcacccgccaccatgcccagctaattttcacatttttaatagagatgggatttcaccatgttgcccaggatggtcttgatctcttgacctcgtgatccgcccaccttggcctcccaaagtgctgggattacaggcgtgagccactgcacccggcctaagatggggtttcatcatgttgaccaggatggtctcaaactcctgacctcaagtgatccactcacctcagcctcccaaagtgctgggatgacaggcgtgagccacagtgctcgacctagtacattgtttaaatggtgcatgtaaaacctcatggtactacaactgcctggtgacagactcaccagagtaaataactatcctgctgttctccaaccacatgggattgccccaaaaaatatttgttgaatcccaggtgtatcatgccagaactcttgcagtcatatatacaatctgtttcattttaataaataggattatcttttttcttcagtttactgtttttaatgtatcatattctagatttcattacacatcaaagatgaataatttctatcatctttcagacatgcccaaaacactcattagcgattttgaacagtattctttcctaaacatcctagttggaatggttgatcctaaaagctaccacgtgtcaggctcacttaagtacagactctggtcaaaacaagctgaagttttaactcttccatcttcaaatactgagcatatttgcttgttttgctctttagcaaaacactgcaaagtcatttgccaggatcccccgcagattggcattcagtgatggagaacagactcctaggtgagatccctggtcacaggatcccgatgactatgactgcaagtctggaaaagaagagacagaacaaagatttaccagcataaccctctgagaatgtgccccaggcatcccggagggaagagctccctatcgacccaggactgcagaatccacagaggaaggagagctctggccaccagggagcagccacacgagaggagaggacccagtgcccccacaggtgaggaaatgagtccatggggctggtcactgctctcgatttcattctgacataagaggactttgtgtagtcaccacctgagtcctatacagtgaacagccaaggagacatggacagattcacccctgaggaacccagtagaatgtgaagtctgccctgagctcacgaaaaaaatgactcagggggctgcctggcctggccctgatggagggggccatggacagaacaacggggagtgaggggtgtctctgagaggctctggtcaccttgttatacaatggtggtgtacatgaccaaaatggacaccaggggatgcctgcgtaccattactgagaagactgggtgtgatgagagcaggaccagcgccacctgtcctgcttggtgccctatgcttagggcttacagatgtcaactctgcaccccctgggaccacatagccccacccctggcactctctgacatcctcaggcagaggagcctgacccagggcccaaggtgggatcagaaagctggagggtctgatttgcatggatggaccctccttctctcagagtataaagaggggcagggagagacttggggaagctctgcttcagctgtgagcacagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccacggtcctgggcccagtctgtgttgacgcagccgccttcagtgtctgcggccccaggacagaaggtcaccatctcctgctctggaagcagctccgacatggggaattatgcggtatcctggtaccagcagctcccaggaacagcccccaaactcctcatctatgaaaataataagcgaccctcagggattcctgaccgattctctggctccaagtctggcacctcagccaccctgggcatcactggcctctggcctgaggactaggccgattattactgcttagcatgggataccagcctgagagcttgcacagtgctccaggccaatggggaactgagacaagaaccctcttcctcctccgccaggagggtgagtgcctgcagctgctgctcacacctgacctgtagcttctgctgctgtagcttcccccatgggcctcggggcatccagggccttgcctaggagtggaggctccaccacttttgtcctcagagtcaggaacagggaccccaggagacagaatatcctgctcctcagcttgggacacagggtctctgcactgaaatcgtgggctgaggtggcaggtccaactgtgtcttcacagtccttcctgtgcctgcccatggtgtggggacggagtgaggaagtgtgggccattgagcttcactagaggcctgagggagcagaggtgctcccgaagacctggactccttccgtcaccctcctcccatcactctcctcactgtagctgtggccaggtgagggctcagggctacttgaggaccttgctcaacccagggcctccatcccaggcattgtttccaaactctgtaagggctgtctctgaatctgtagaaacatttatttctatgtgcccaggactgggttagagggcaccaaccccaccccttgcaaactgctcatcacctctcagtgaaacaatgaggagaagaaagagttagaaatcagaagcctccccaaggctcccctctctcctctcaaccagcctccccttggcttcctccttccacagaaataaagaggaggcagccacagaaggcaagggaaggtccaggcattataccaggcagtggagccagccagtccccccagatggtggagggaggtggtggaggtgtctgggaccagaaaatagtgaggaccctcttactaaagtgaggaggggtggcataaactgaggctcagatggtggaccagatctcctgagccatctactcatttcttcttgagtttcagtttcagtaagaataggataaaaaaaaagtctgaagaggttcctttcctcagataagaattcgtagaggattattgcccactcaggcattgaggggaggctgagcctccctctcaggccaatagaactgggggctttcatgggaatttgattgtactgaagctcccagactctgacatctaagacttatgctctcgtagcagagcccagcactgataccaaaatggataaaggctgattgataagcctggaatatcctagctgacaccgacttgtggaaaagagaatcaagttagaatattgatgtgataaggtggcatcgcacagtgaggagaggagagcttgtgtgggggagggtagaggagccattagagggttggacaaagaggacacagaatctgaggtaagtttgtgaggaaaactccagatgcttcagagaagatggacaaggaggtaggcagtatgaaggccatgggaccagctctagtcaccgggagtgagtggtgagattcagcaccagtgtctggggaggaggtactgaagcctgggtgaggggagatgctcaaggctggccttaggacctgagtggggcacagtgatcacactgctggggggtccttcaagtgcaagggggctgcaggaaggctcgagctcattgtcacaatgaaaacttagacaacagctccccagacttgttcaaaggtgtcacaggactttttcctctccacatggcaacggggagaggaaaacttatctctgagatatataagatgtttgttctccataacctctcctgtcccctggctgaattcctatttggaaacaaaatgactctccagttttacatatgacatcctcactaaaaaaaaagttccagaatgagaaagatctgccctccctgacccactggtgaggaatctcagccttcaggacaaccagacgaaatcgttcatgccatctcccatgacagcatcatggggaccagggagcatatcttatgggtttgggccacacactgcctgtcccaaacattgcagctggggacacttatatgctgaactcatggctgggagatctggggtctagacatgacaggaagaggaaaaagaccaggagctctgcctaagtagccccagtgtgtgaatcactctaccctccaccctcaacttcagttcgtgatgggtgttgtcttgcgaaaactgacagctgggctgggacacaggcaagagagactctgacccacaaatctccatcgtgggctctctggcctttctgatattctttttgcacatcaattctgggccaagacacatccatgctcatcaagaaggcattgataggagaatcaggtagcctccagagagacaggaagcagataaacaccctcatgttggcctcctaagctcagaggagaaaaaaaagggaaagaagttcaagaagccacactagaagccactgatcaccatcacctcggcacctgtcctccatctgcccctctttcaagtaaggaccagactcaggggacagcacctgcacctccctttctgtccatgcactgtgtagggagcctccttctgctctcatctcaaggcgactgctccgccaggtcagccgtgtcactgctgagagtcttacctcagtcctggtcacagggtcttggatcagcagcaacctggctttgattcagctgtgaccctgccccttcaggacacaaagccgatgattaaagcctaactgaactctcctagatttctcaaaccttagattctccttctctgtgtccctctagaaagtgccacctctaccaaataatttcatgttatttcctcaggtctagagctatttgattaccaaaattctatactcactcttctgctctcattccttgtcatggtccattttccactcaggagctaatgatgccaaccctgtatctacaggccattgtcacaaaaaaaaaaagaaatgagagggttccttagataaatacagggttagcaaagaaaagtttcattaccccttaggaattactccaagatctaagaaaattaattccagagcttcaagagtttactcctcagaaacaacagcatgaatacattaggtagtgaatgttcttggtcttctcaatgaataacctctgaaaggttcagagtatacgtttcaaaaagataagtgcataactttcacaaaaatgtaatcttaacttatgtcatcaattttaattggtatatatatttctggaaaaaaaagcagtatgatggtaaaagaaatgtaaaaaagcctttgtaaaacccagtgcttacagtccaccaggatagcacctgtgaagcaaattttctttgctgaagatacaccgccttttagaataatagcaagatagtttgaatttgtcttcttctctcacaacaatctaaaaattaacatgatcccatttatatgaaatatctagaaatatatctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtcaacaagctcctggacttggggaacaaaagtacatcttcttggatttctgaggacttgccctgccagggtgtctttctcaatccaatctctccttcccggcagtccacttctcctagatcctgtaatttatctaatcttattcatctgtatctacttcgtggacttccttacatcttcacctgaacaccaggaatcttcaggtcatgcccatatgcccttggttctcctgtagtcccttcttccttcttcccctgtgatgccaccaagtcgaagtctcttctcagaccctggagtgcagcagggacttctctggtctctgccccagggattaagggggtggaagagtggactcctgtgcccttcctatgcctgtgttttcatcagggttagctgcaaaaggtagggattaggctgtctaggtagggattatggcattaggtagggattatggcatttccagagctgagctctatgcccagcaaaagatacgtgctcagcaactacttgacagagacctacctcttatcacatgggacacattatactggacccaggatggggctgaactgggagaggtagctgtggacctgctcctcgctctgccctcaccctaagagctgatggggcatccaccaggaagagcattcctgggcagggagagggccatgagcagccttgtcctgtatgtgagacacagctcagcccggtcacaagatccagatgactatgactgcaattcaggggaagtagagaatgaagattgaccagaataaccctctgggaatgtgccctgggcctcctagagggaagagcttcccttctattcagcgctgcaggatccacagaggaaggagagccctggccaccagggaggagccacatgagaggacccggtgtccccacaaatgggaacgtgagtccatgaaagtcggtccctgctctgggtttgattgtgacctatgaggacattgtgtagtcaccacctgagtcctctacaataaacagtgagagcgccacggacagattcactcccgaggagcccagtaaagtgggaggactgaggtcacagggagaagacacaggcaccacctggcctggccctgacagggggcagtggacagaacagtgcggaggcagtggggtctctagaggctctggtcaccttgtcataccatggtttgtctcggtctggacactagagggcacttggggatcattcctgagaagactgaggttgatcagagcagaaccagccacctgtcctgcctagtgtcctctgctcagggctcacagctgcgtcctttacacccgtgggaccacacagccccacccctgccaccccctgacatcctcaggcatagggacctgacccagggcccagggtgggattagaaagctgggggtctgatttgcatggatggaccctcccactctcagagtatgaagaggggcagggagagatttggggaggctctgcttcagctgtgggcacaagaggcagcactcaggacaatctccagcatggcctggtctcctctcctcctcactctcctcgctcactgcacaggtgactggatacaggtccaggggaggggccctgggaagcctatggattcttgctttctcctgttgtctctagaagccgaataatgatgcctgtgtctctcccacttccagggtcctgggcccagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttccacagtgctccaggcccggggggaactgagacaagaacccacttcctcctctgccaggagggtgagccccggcagctgctgctcaggcctggcctgtggcttctgcggctgctgcttccctcatggtcccaggggcatccagggccctgcctgggagtggaggctcctcctccccttctgtcctcagagtcaggaacagggaatccaggaagcagaatatccctctcccttaacttgggacacaaagtctctacactgaagttctggactcaggtggcagatccagttgtgtcacctcagacccacctctgatagggaacccatgtattcattattctcctttccccaattccaggagtttccggagtggtgtcttcctctccctgctcctcaatgtgagtccctgtgtttcttttctcccaggcctattctttttttttttttttaacaaaactcctttcatgaaggaaaaatgcacacctaataaaccagctgaatttatagcattaaattcggcccattttggcatttttctggatctttgaaaatatcaccaccactgagctatgcaacctctgactaaccccagcagcccttcatgatgctttgtcatctccttcactccccgaatgccctcctgggcagccaggaatctgcctttgccactactgtatggtttccattttctgaaacttactagtgttatcaaacactatcttcccatttgttcgagcttctttcactctgcacacttcttttcagattctccctgctgttgctgaattgcatcccattctacagagggctcattacaacctttgagggtctaggacattctcttctgattctatttatttacttatttattttaaagtttgaattcattgtccatcaaatcaaactctacgggtgatgttcatctaaggtgacaggagtcagtgagggcttctcaggattcttgcttcttcatctcttccctctaattctttctataatgggagaatttcttatctttttaaagtttttctatttattattttatgttggcttttaaggtttttagtgttttttaaaatttttttatttcaataggtttttgggaaacagatgttgttttgttacataaataagtttgttagtggtgatttctgggattttggtgcactcatcacccaagcagggaacactgtacccaatgtgtagtcttttatccctcaccccatcccaccctttctcctgagtccccaaagtccgttgtatcattcttatgcctttgtgtcctcatagcttagctcccatttatgagtgaaaacatatgatgtttgcccttttattcctgagtgaattcacttataatgatagtctccattccatccgggtttctgttaatgccattatttcattcctttttaaggctgagtagcagtctacatatatatatatatatatatatatatatatatatataccacatttgcttcatccactcattgattgatgggcatttgggttggttctatgtttttgcaattgcaaattgtgctgctataaacatgagtgttcaagtaattttttcatgtaatgacttcttttcctcttggtagatacctagtagtgagattgctggatcaaatggtagatccagttctttaatgaatctccacactcttttccatagtggttgtactagtttacattcccaccaacagtgtaaaagggttcccttttcaccacatccatgccagcatcaattattttaatttttttattatgcccattcttgagggagtaaggtggtattgcattgtgactttgattttcatttctctaatcgttagtgatcttgagcattttgccatatgcttgttagccatttgtatatcttcttttgagaattgtctattcatgtctttagcccactttttgatgagattgtttgtttttttcttgctgattagtttgagttctttgtagattctggatattaatactttattagatgtatagattgggaagattttctttcactctgtgggttgtcagttaactctgctgactgtttattttgctgtgcagaggctatttcatttaattcagtcccatctatttatcttcgtttttaatgcatttcattttggattcttggttataaagtctttgcttaagccaatttcttctagaatttctaaggtttcatgtcttagatttaagtctttgaccaatcttgtgttagttttgtataagatgagagatgaagatccattttcattcttctacgtgtgacttgcctattatctcagcaccatttgttgaatagcgtctccttttcccactttatgtttttgtttgctttgtcaaagatcagttaactctaagtattttgcttcatttctgcattctctattctgttacatcggtctatgtgcctatttttataccagtaccatgctgttttggtcattatggctttatagcatagtttgaagtcaggtaatgtgatgcttccagatttgttatttttgtgtagacttgttttggctaccggggctctttcttggtttcatatgaattttagttctatgaagttctgtgaagaatgatggtggtattttgatggaaattgtattaaacttgtagattgttttggcagtatggtcattttcacaatattcattctatacatccatgagcataaaatgtatttccatttgtgtcatctgtgacttctttcagcagtgttttgcagctttcctggtagaggtctttcactttcttggttaggtatatttctaagtattttagttttttggcagctattgtaaaaggggttgagttcttgctttgattctcagcttggttgctgtcgttgtatagcactgctactgatttgtgtcctttaattttgtatcctaaaacttgctgaatactttcactagtgctagaagcatttggggtgagtcttcagggttttctatgtatacaatcatattatcagcaaacagtgacagtttgacttcctccttatcagtttggatatccctgatttctttctcttgtctgattgctctggctaagacttccagtactacgttgaatagaagtggtgaaagtgggcatccttttgttgttccatttctcaggggaaatgcttttaacttttccccattgagtataatgttggctgtgggtttgccatagatggcttttgttgccataaggtatggtcccttctatgctgattttgccaagtttgaatcataaaggatgctggatttcgttagatgccttttctgcatctattaagataatcatgtgattttgtgttttaattctgtttatatggtgtatcacatttatcaacttgtggatgttaaaccatctctgcatttctggtataaaagcaatttgatcatggtagattatctttaagacagctgttggatttgggtagctagtattttgttgaggatttttgcatctagattcatcagaaatattggtctgtagtttatttttgttatgtcctccctggttttggtatcagaatgatactgtcttcacagaatgatttagaaaggattcccattttctctatgctgttgaatagagtcagaaggattggtaccagttcttctttgaatatctaatagaattcagctgtgaatccatctggtcctggattttttgttgtttgcaattttttttattaccatttcaatctagctgcttgttattggtctgttcagagtttctacatcttcctggtttaacctagtagtgttgtatatttccaggagttcatccatctcctttaagatttctagtttatgtacataaaagagttcatagtagcctttaatgatcttttgtatttctgtggtatcaatagtaatatctcccgtttcatttctaattgagcttatgtgggtcttctctcttcttttcttggttaatctcgttaatggtctgccaattttatttatcttttcaaagaaccagctttttgtttcatttatcttttgtatttttttttgttttgacttcatttagttctgctctgatcttcattatttcttttcttttcctgggtttgggtttggattgttgtggtttctccagttctgtgaggggtgaccttagattttctacttgtgctctttcagactttttgatgtaggtatttaatgctataaactgtcctttaagcaccacttttgctgtatcccagagcttttgacaggttgcattaagatttagaacaattgcaatcttactatcaatcaacagctttttaattcctgaggatgtgacctcatttaatcctgacaatagctttattattgcttttcaggcagtagaccgtgattgaagaggtaatgctttgtggcctggaggtaaggttctaaaatttatcaaatattaaattggtgcacaagtaattgcaggttttacaaataaaagtaatggcaaaacccacaaggacttgtgcaccaatgtgatataaacactggaggtcagttaaatttgaattcagtaaaaacaatgataaagaatctgtatgtgtatcacccacacagtattgttcaattgtaatacaaacaactgggtgccctgcattttatcgggaaactccacacagggttcgcagcttgaaagaggcagagctgtggcaggcctgcccttcctgatgccaggtctaggtgcttaacgtcaaagacagagcttctctaagagagctaccctcaagtgaacatgtcagttggcactaaatacatgtgatatgatccccagtcaatgatccccactcacttccctaattctttctattatcctttaagtttgcagactcagggcctccccagaaattgctgcagcctgagttctggacctgggaccgcatgtcctgtcacaaccagatgcaaaagggctctttagtccctacacagaatggcttcagccaggagagcataaataacatgtaagattagaagagctcagaggggctctccttctgtcccatgacagatgaaacttcagggctctgatgcttgtcagggaatctccttcagtgaggccaagatcccaggactttactaaaattagcagagtggaccagacaggcatgtcatggtacaggaattgtgttcagaacaataagtgcagatgcatcttaacaagggccttcacgttctatctttggtgaaaaaggaaatagacaaaggcatggagaaactgaaggactcaatgggtctgggactgaggtagcgctgagtgctttgggcttgtcctggagcagtctgcagatgataacagctgggaagtccacccctgctgtgaccttgtttcatctgcccactggatcagtggctgtgtcctcacaggaaagctggctgtagccagactggccttctccatcccacctgggaaatgtattcagatgactctctggggtgaggttctactaagggcttgggagttatgaggagggggctgatttgcatgaaagaaccatttcaccccctttccttcatctaaaacccattaatagaaacttcagggccattcatagaagtccagctggtctcctacatttgtggggcataaaggatcaatgcctgatgaatgcctgatcaatctaaaggaagaggggctatcagcaggtagtggtcagagtgagaaaggaactgacttttttgagagattcatcaacacagccaccaactctgggacaaatggggtgactctctgtaactgtcaccccaaattacccacaggacactgagccagtcccctcattctattgcttctggttctagtccattcccctattgtccctaaacacgttgcccatgtctgagtccagggtggcagggatacctccatcccagtcaacatctacagagggcctcttctgttcccctctcacctcatgcaggttactactgttgtgggtctggtggagtggcccctggagaacacaaggtatcccttcctctggaaagccaggcatgtaatagacatggtatgggttgatgtagagcagagtggctcatccagatgcaaagcagtaagaccttggctacagaaaattatttcacaaaattccacaccctttcatgacaaaaacactcgatgaactataaatagaaggaaactacctcaacatagtaaagaccatctatgaaactcccatagtttacatcacataaaatctgaacaaccagagacattttctgtaatatcaggaacaaaccaaggatgcatactttcacatcttcaattccaaatattattggaagacctaggcagagcatttagcctagaaaaagaaataaacagaataaaaactagaaataaaagtataaaattatctctgttttcagatgacataatgtcatatgtagaacgccattaaaagacccagaaaataattctgaaagaatgattaagtgaatttggtaatgtttcaggatacaaaatcaccacttaagaacatctcatggctaggcatggtggctgacgcctataatcccaacactagggaggctgaggtgggagaattgcttggggtcaacagttcaagaacagcatgagcaacaaagcaagaacctgtctctaccaaaaataaaaaaataaaaaggaaggaaagtcacttgtatttctatacttaaccaaacaggacaccacccaaaatgaaattaagaaaacaattcaagaggacccacagaccctctgaaggaaggggactgcacccgcaggacccgggagacaccgcaaatactgtgagtgcctcaactgcggaagtgggaaaaggagaccctcctctcccaaacacacacccctactgaagaatgtgaaagtctgttagcaggagaagttctcaactttacctggaacggagttaagttagacagccaagctcagtgaaatacacaggtgtaggaggtagcggggaggccctgggaacttgctgaatccccaagcaacccattcctttctggcaccacaggaatacatcaggaaggaggacagacaagcagcgggtaaaactccacgggaagaaggacttccctagctgaactttgcaacaattcgaatcgggtgagaggcctcctggctctagtatccatggcactagtatccatggctgagaggcccatggatagttcacatcacaggactctgtgcagaaacccccagtaccagcccagagccgggtagacttgctgggtggctagacccagaagagaaacaaaaatcactgcagttcagctcgcaggaagacatccacaggaaaagggggagagtgctacatcaagggaacaccccatggaacaaaaaaaatcttaccagcctttagccctagacctctcctctgacagagcctaccaaaatgagaaataacttggggggaagagtgggagaggggcgaggagtaaaagacaacaaacatggtacagtgtatactgctcaggtgatggctgcaccgggatctcacaaatcacccctaaagaacttactcatgtaaccaaacaccatcttcccaataacttacagaaaaaaaaaaaagaatattataacaatggaatcatatattatgcagcctttcagcattggcttttttcacggagcacaatttccttgagatatatctgagttgcgttgtatcaattatatagtttgtttctttttattgctgagtaatgtttcatggtacggttgtatcaagcttgtttaaccattcgccagttgaggaacatgtggattatttccagtttatttttttggctattaggaataaaactactatgaacattcttatacattaaaaaaaaaagaaaacaattcaaatttcgtcattagaatgagtaaaatgcggctggcacggtatctggtgcccataatcccagcactttgggaggctgagacgggggatcatctgaggtcaggagttgttagagaccagcctggccaatatggtgaaaccctgtctctactaaaaaaagattaaaaaaaattagctgggtgggtggcacactcagtgattgcagctactcatgaggctgaggcacaataatcacttgaacccaggagacagagtttgcagtgagaggagatggtgccactgcactctaacctaggtgacacagtgagactctgtcccaaataaataaataaatgtaaaatacttaagaataaacttaagaaggtaaaacacttgcacattgaaaacaataaaacattgctaaaagaaattgaagaatacacaaataaatggaaagacgtttttgattatgtattggaaaactcaatattgttaagataccagtagaaaccaaaataaaatatactatagagtcatcacaatctttatcaaaattccaatactacttggtacaagaatggatataattctaaaatccagatacccaaaatagccaaaataatcttgtaaaagaagaacgttgttggaatcctgacacttcctgattccaaagcatactaaaaagatacactaatcaaaacagagtggtacatatagacagacatacagacaaatagaatagaattgagtgccttggagaaaactctcagttatatggtcaaatgattttcaacaagcttgccaagaccattcgtgagggaaagaacagtctttttaacaaatgctgttgagaaaactggatatccacatgcaatctggaagtgaatcaaagacacaaatgggagagccacaactgaatcttaaaagaaaacattgggaagtaggtccacaacgtagggtttggaaatgatttcttggatatggcacaaaaaagacagggaaaacatagaaaaagaagaatatagataaattgcatttcatcaaactgtaaaacttatgtgcagcaaaggacactaccaacagagtgaaaatgcagataatagaatgggaaagattgttacaaactttatatctgataaggcatccaagctatagaaagaacttctacaactcaacagtaacaacaaaaataggaataacccgaaaaaaacaaggacaaaggacttgagtagatattactacaaaaaaagatctacgaatgtccaataagtacatgaaaagatgtacagcatcaccaattattagtacactgcaaatcaaatcacaataatatacaactctatacccattaggatggcattaaccaaataacagaaaattaaaagttctagcaaagatgtttagaaattgcaactgttacgatttgctggagagactgcagaatgatgcttccactgtggatgccttatggctgttcctcataaaatcaaacatagaattaccattttatcagaattttcacttctgggaatgtgcctgaaaaaattgaaagcaagatctcaaagagaaaattgtacatcctcgttcatagcagcattgttcacaatagctaaaaggtggaggcagcccaagtgtcaactaatgaatcaacaagatatattatacacacacaagggaatattattcagccttaaaaagaaagtctgacccatgcgatggcatggatgaacctttaagacatcatgccgtcagaaataagctgacttcaaaaggacaaaaattgtttgccagcccttatatgaggtacctagaatagttaactccacagtgacaagaagtaaaacgatgtttcccaggtatgaagttttggtttgggaaaataaaaaatttgtggagatgagtggcagtactgtggttgtacaacagtgttaatttacttaatgtcactgaagtatacatttgaaaattgttgaaataatgtattttgtgtatgaatattttactacagccaaaaagaggaagatttatgtttggtgcagtttctctacctccaagaacagtggaaacctacaggactaggagagtgtgcatgagtatccaggacactcttccttttatgccagccccacagcatccaggacacccttccttttattccagccctgcagcatcctaacaagttaagagagtcagacgtacctcattacaggtgactcagaataatatgagaaagtctagaggtggccatgatgttagcggtgggtgcccaacccagcccaggagcagccgcaaatgcaacagtggccaaagaaggggagatgaagctggtggcagaggtagcagcccctccagctggagaggggcatctgcttctgtacaaaatggttcacagttgataagtcttgcatagatgcctcatcgtttacctcatgaccaactacagttttcattgcaatgtacgttatcatagcagtaatgtctatttcctcctgtagcaagcaaacatgaacgaaacgtgctttactgctttgtccaacaggacatgttagtcccaaacacaggctgaatgtttaaaggtaacgttctctaaagataaggatattataccatttattgataaatacggggattgcatgatgaccattcagacacttggaataattacttggctaaataacattgtttaaacaatgagtaaatttagttattctttgcagagcaaaaaagatccaagtttcaccagtcccttggcaaacactacatttcaaactatggaagggagacatcctgaaattttgtgctactctttctgaagacacagaaacagtcaagtcatacctaatacttatgagcataaagctttgataaaattcaagaattatttgcattttgaggaaaaagactttgtcgctaaagcagagaagaacctaaaacggactcctcatagtgagctaatattttataaaaaggtgtcaatcaaggtgtggcttacaaaaatactttcaaggatgtttactttccagccatctcactggacaagaactgggtggttttcattaactttggactgtgctttaatttcctaaaaatgatgtcacttactgccctgagtgacatgggatgggatgctgtggtagagcacactctggctgatgtcttgtacctgctggagacagaaaaggatgggagacacagtcctccacaggaaatctcaaatgggtccctctttcttttcagatatggactttctggggagtaatactgtagggcttttcttgttgttgcctttaactgtctcaaatgttctcccaaagatgctactgaacacagcctctcctttgagcaagttaaaagtctgggtacgactgtgagaggctcctgcctgccaacactctttctccactttcagtgactgctcttcttctgagggccgtaaaccaacaactgctcatcccaagatccactaagccctctgggaaattggtgctgtactgcataccctgcctgctgggacttgttacattgatgtattttctaaggagtgaataatcttgtccaagtaactaacttatttaaagacattttcttcggtgggcactgactccatggcacccgttttccaaggagttggtgagcttgtttctgagaatgccagaaatcaatgtacattccaaatcattctaaaagtgatttcttttcggtgtgggtttggttttgttattaattttgaaatatatctttgaatactgagatctctgaaactactagatctctagaagtgtaattgggaaagaaggttgcttgcagctttaacaaaatgagaaactcttcccaaatacaacctgttttgaagttaaaaaaaaatgtgacattagaacctgcaaaatctaagagtttccaacagcagtctcaattctgatgctaactgtaagctagggactcccccaacaacgcttcacttcttatgattcccaagaaggactcacatcactcactgaaacttgtgacgtttgttgatatgattttttacaacaaaagaatgcagattaaaataattcaaggaaggaggtacatgggcagagttcaggagaattccaagcacaggcattcagttgtcctctcccagtaaagtaatagacaatgctgcattctcctggcagcaatgtgtgattctgtgcatgaattattgccaaccaggaaagctcgctgaagcttggtgtccaggcaggtttttttgggggtgtgagttggggatggggttgcttatgtagaccttgttgatcatccttatggctgactccgacttgaatttccactgaattgacaataaaacttcaaccttaaatatttggttattttctttttaataaattctctaaaataaattattttgaaaatgctcgctttagctagctgtttatccaatatgagactcaacataaatagtttcaaaaagccagtgggtcattaaaacaattcctttagtcatccaaaacattcagataaaaattaacaccatgtaacactaaaatcgaattatagtcactggggctggatttcaacaacaggaagagaaagtagtacaaatagggatgagcaaaaaatagacaagtaatggatgtgaattggcctaggaaatttacagtggcaatgtcaaaaaggtaaatcaatagttatttgacaatacatgctcagtccaggaaagccaccagggggcggtctgggtcgtctgcatcataagaagctcaaggagttcaaactgaatgaaccctgcacagttgctcactgggtcgtgtaaaatgttagagcagctgcttcctcccgcaacacacggccactctgggcagtcccctcacagtgtggctgctctcagggctgagaacctgggtggtgctaaaggtggtgaatgtggtaaagatttgcataaagcaccacacaacacacctcctccacacagggatctcagtagcatcttcaaaggatgggctttctgagctaagagcaataagaagaaactttctaaacttactaaaatttatttattgagttatgttcaaagcaatacatgcctattacataaaatcagaaagtatttaaaatcaccgagttctcggcaaaggttctttattccaagcaatcaatatgactatttttttttatttggatgcattctttcatttttgttctcagtatttccacaatggtgatcaagccttgtgctttttcatctgcttttatacccctttatgatctagtcatttcaggttaatgtaagtagtgttccatttcttaaaagggataaaatatttaaatagttgctaattttatttttatttgaataccaatgaaatattatcatttttagataattcttattgtttgctactcaaacgaagatatgatattatcttattattaaaacactcctggtaacttctgtggattttgtgaggtcagaaaaaaaatgcctgaaattttcaatggaaagccttgagtacattacacctgacttcacaatgcagtaaatagagaaacaagagtttccgattcatgtaagaaggagcataacagattaaggtatgaggaataatttatatccaaaactacaccagtgtctccaggcatgtgttagaacagtaccccccaaattctgttgtgcatatgcatcttctggggattttacaaaatgcagattctgattcagtggctctggagtgaggacacagtctctgcatttctagaaagttcctaccacacaaaatccacatatatgtttgaacaataacaaggccagccaggagaagaggctcaggtgtgtaatcctagcactttgggagtttgaggcaaaagaattacttgaggccaggagtttgagaccagccagggtaacgtcacaagatcttttctctacaaaacatgtttttaaataataaaaaatgaattagccaggcgtagtgtggcatgcttgtcatcgtagatacctaggaggctgaggcaggagggtcgcttcaccccaggagttcaaagctgcgatgagctatgattatgccactgcactccagcctgggtgacaaagtgagaccttacctctaataacaaaaacagccataacaaattcataagaatagtgtaaaataaggagaaaccttggcagacaataacctaagagatatctcagacatagtgaactaatgtgtttggatgacagaagaaccccacacttggctggctgtggtgactcaggcctgtaatcccagcactttaggaggccaaggcgggcagatcacctgaggtcgggagttccagaccagcccggccaacatggaaaagccccgtctctactaaaaatgcaaaattagccgggcgtggtggcgcagcctgtaatcccagctactcgggaggttgagccaggagaatcactggaatccgggaggcggagtttgcggtaagctgagatggaacgagccacactccatgcaggaagacgaccagggaggacagctgcaaagcagggagaggctcccctttctttaagaaacaaaacaaaagcaaacaaacaactaacctgacctcccctctggctcccatccaacattcttactagcttctcatctagtcttttctgtagtgtagcccatccttaccctctcccctcccacatctctgattcctgaattcccttcttgggtctctctccttttcctgtcaaccacttctcccctctatcatcctgagttaattatcaagagctttatagcaggaagcctattggtatttttccagattttttttcttggaattggacattcatacattttctctctttttttgggggggtagggtggggtgggggtgggggtagggacagggtctcaccctggttgcccaggctgtggtctcaactcactgcaaccttcacctcctgactcaagcaatcttctcagctcagcatcccaagtagctgtgactatgggcacgcaccaccacaccctgctaatatcttgtatttttggtagacatggggtttccccatgttacccaggctggtcttgaatttctgagctcaagtgatccaccctcctcagcctcccaaagtcctggaattacaggcatgagccgctgtgcccagcctattttttctcttttacgagcctctctgattccctagttctgaagtagcccagagttggctgattctcctattttgcctcagctagcacttcctccttctcctttttttttttctccttctgatccctggagtcctctgcatttccactgaatccagtgaaccacacaagcatgctcatttattctccccaaactccaccactctgccttatgtgctgatccagtgagaatcaagaaggaagagagacccatggatttctgtgcagcctggaaagtcagttcatggctggacttggctgggacaccagacacctgtctccctgtctctatttagtattcatagggcccagcagctgcatcctcccagggtgcctgaagagtcactgaccatgctctcctacccagcctcaagaagccacccagtcctcgagaagtataatcagactcagcatcttatgtgaagggaacaaccatggggacaggttagacttgcattgagtcccctcctctaagaagggccagggaaaaggggctgttccccctaatctgtgtggctcaggaagtagagctccagagacttctctaccatggcctgaatccctctgctgctcaccctcctcagtctctgcacaggaggctggagatagaaaggcagggactggcactgggaggaccagggctctgccttgctcccccggctcaccgagccacttcccacaccctgtgtctctgtcctgactcttagggtcctgggcagtcagggctcacttggtggcctgcacagtttgtctgtgactaaaccagccaccatctcctgcactggaaacagcagcaataacgtccttggaattgtgtcctggtaccaacaatgaacaggaagtgtccttaaacctctgatctgtggatgtaaatatccacctgcagatccagaactgattcttgagtgatcagtctggcaaggaggccttcctgagcatatctgggctccaggctgaggacaaggctgatcactaacgttggatttggacagttctctggaggcccccacggtgctgcagtctgtggggaagtgagatgggaacatttcaggtctcctaggagcacgacccgacagcaccacctacaactgggaaaactgggctgtttaccatttgtgttcatgtttgcttgggctggtgctagccagggcccaggtctcaggtcagggacagtgatttagagaatgcagctttgtttcctcagagtcagccctcagagaaagcccatagcaacagcattgtcaaattgcctcaaaaaaaatcagaaagtccttggttcctggaacaggctgccctaggaacagagcccaatcggtcagagcaagcagggacacaactgtgcagaaaacaacaagttttacttagggagataacggttgactgtataaaatgagaaatatgtcacactactcacttgtaaaagtaagtttaccaatgctattcatttccctatatcactacgttgagtaaaaactctaaaatgtatgaaaccactgtagagataacttttgctgaattgctactttaacatgtcatggatcatttatttttcttgcaaaattctcattattcaccgtccttttgagtaacccccagctgcccttcaacctagctcctcagctgacctcttctccatgatgcctaccctgatggcacatgtgggcagttaggtttttctagattttaaaagttatatatgtacatgtctacatcccatggaccaagactcactctgggagtgagaaatcacaataatcatgcatagccttatggaattagtgtctagcaatcagaccatagaggtgtgaatagagacagtgactaatgagctgcagagatcagctgggccatcaggaggtaagtgtcctctaaccagcatgggatgctgggggactgccctatggtccctacacagctgctcagtaaggaccattcactcaaagaaatccaagactaggggctaagaccccgtgctcactgaggggtacttagcatctatgtcctcccatggcatggcagagtcccctgagcaggaaggtgtgtatggtttcagtaggtgctttcttccggagccctctcaaggggaaaagcaaaacttcttcctcctcagtctgcagtgtgagctgagcttcagccccagagcttagagaggggctgggcagtccctggatgaaaacacatttgcatgagcagcccctcctctgcagagtatgggaagaaaaggaggcctggggcagcccagtcccactgtgcatgtcaggctgtgtccaccatggcctggactcctcttcttctcttgctcctctctcactgcacaggtagggacaggcctcagagatcagggccagccacccaacctgattctggctcttctggtaaagatccctgaaaaacctcaccctgaaccctgcccatcaaccatgagtgtctgtgtttgcaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgcttctcacagtgacacacacagatgggaaagtgggacaaaaacctcaccctgctttaggtcttgttcttaaaaaattttaaattttaaaataactggcctaggcacaaactacatttggaagtactttctagttgtaaaaggctcttctctcaatttcccatccattcgtctgaagtctcagtaaaacaaaacaaaaccaaagcaactgatgacactgaagtcttggctggttgtcatatgtgctaacaccactgcctgtggagctggacttttgttcttgaaagaagcaaaatgaggctttcctagctcacatcatggtcagagcctggggacatcctagcaggtgaacagtgccctgcagcatggactctgctcttccagcgtacgggcagagacctccccttccatccccagtagtctgttctcagggctgtctgtggctcactgtgtcccaggaacaaggcactcaaatatgaaatgctgcctgaggacacaggtcagggaattctagatatagtgctgacctggctcagtcctgggtacctgcatttcagtggcaatgtcaggagatggggttaggtattagggtaactggggacctgagaccagtaaacctctatgtaggacatgacaggagagtcaaggggaggctccactgtggctgagacaagccagaggctgctccttggccacgggggaagtaggtcccatggatgtgactttcctgcagctcatcccactcaggaccatggggactgctgagcgtgggtttcttgatccctcagcgcctgtgttctcttctcctctcttacaccattggagcttcttgctgaatcagggtctagtggtgagtatgtggaaagaccaccacatctcaaggtcacctttttctgcatggggagcagcagaaacattgggcattcccgtggaaatggctacggaggcctcccagaaagagcccccaagtttatgacctaggacagcagtgatggtccctcaggggtcccagcctgattctcctgctctgggtttatccacacagcctcctggagcacctcttggctccagcctgaggactggctggttatcagtgtcacacagctgcatcctgactccatgttaccaagggttcctgttccatgtggaaatgagagaaagatctgccccactcatcctgtctccccatccctcctttatccctgcctgtgaccaacaccagttcatgccaagacttcggctgtcacttgtgttactgaagcagagcacaagttcagtaaaaataatcccttttcttactggtctcccaatgcaaacagaatcaatttgtttctagaagcaaaaggagctgcccacacatggtgggtggggatgaggtagggacaagaaagaatccaccctgtgtgacccagaggcccagaagcctttagtctggttccaaaggtgtctcctcctcttggtgcagttatgctgaccatttcctgagctcagaaactgtgcgagagatgccaagaatgaagaatccagcctgtgtgacccagagacccaaacgtgagacaggaagtctgatgcttaagaaaacgtgggttcagcattctgaaaggtctagatatggcttggcctagagctggtgtagaagagaagcaagagagatgctcagccttaggtggcccaggcacagcggtcctgtcaaggggttgagctctctgcaacatggatatcctgcagagacatacttggggaggctgtgatcccagaatgacacaaaaatgctaatggaaatgagcaggggattgtttatgggggaatggggagacaggtgtgggataagatgtggtaaggagaatgcagcctgaagaggagactgtccattgtgactcataggaggagtagggccggggcctacagtagtgataaaaggaggacctggaaggacctgggccctgaagacacacagagactggagttttggtctgtctgtgagggtcccatgaggataaaaatccatggtcagtgtcctctgtccagggctcactgtcccagctgttgtccctcctggatcctctgggtgtccagattccgtagctgtggacctgttctcctctctgtcctcagcctaagagctgatggggcatccaccaggaagcacatctgtgggcagggagggggccatgggcagccttgtcctgtatgtgaggcactgctcagcctcggtgatccctgttcattaacgtgggaggaaaggaaaacaaaattcactgtgaacatctatgcatcatcaaagaaaaagcaatgagccaaacaggaagtgaagcccagctctaatagtttgtttctacttggaaataaataaaacttaatatgcctgatgtgttacgtaaatgcaataaacattttttgaaagctataaaaattatgtaaaggaacatggcttacactaaaaggaacacttaaaataatgacacccttgaaatgcaatcccaaaacacagcatacattttatttcagttccatatatggactggttttatttaaatgtctatattaaatctcactattccatttttaaatggagcacttaaaatctcattctacggcaactgcctggtgatacatttaccagtggaaatatcaacaaaaccatccagctgttttcctccatccccatagaattccccaaactagtaattattaagagcccaggatgtatcatgccagaattcatgcagtcgtaggcataacctgtttcatttttcattctgatcaacagaattacaatttttcttaagcttgtttttagcttattagattctagttgtcattacagatcaaagataaataattttctatcatccttaagccacccccataacactcactactgaatttgaaccataatttttccctaaaaatcctagttggggtgcttgatgttgagagctaccacgtatcaggctcacctgaggacagactctggttaaaccaagttaaaattttaattcttcccatcttcaaagactgagcatctttgctctttttgttcataagtgaaacactccaaagtcatttgccaggatcccctgcagatgagcatttagtgtacagactcctaggcaagatccctggtcacagtatccagatgactatgactgcaaatctggggaagtagagggagaacaaagatttaccaggaaaaccctctgggaattcctccccagggaatcctagaggaaagagctccctttctcctcagcgccacaggatccacagaggaaggagagctctagccaccaggaaggagccacatgagaggagaggacctggtgtccaacacaggtggggaggtgagtccatggggctggtccctgctatgggcttgatcctgacataggactttatgtagataccacctgagtcctctacaatgtacagccaaagagccatggaaagattcactcctgaggagtctgaagactcctcagtagagcgtgaagatagccctgaagtcacagggaggagacacagacaccacttggcctgccttggacctgagagagggggcagtggacagaatggggggaggaagccatgtatctgagaggttctggtcaccttatcatagaatggtttaccttgatctggacaccagagggcgcatggggatcattcctgagaagacaggggtgatcagagcagaaccagccgcctgccctgcctggtgtcctctgctcagggctcacagctgtgtcctccccaccccctgggaccacaaagctccacccctgccaccccctgacatcctcaagccaaggagcctgacccagggctcagggtggggtcacaaacctggggggggtctgatttgcatggatggactctccccctctcagagtatgaagaaagggagagatttgggggaagctcagcttcagctgcgggtagagaagacaggactcaggacaatctccagcatggcctggtcccctctcttcctcaccctcatcactcactgtgcaggtgacaggatggggaccaagagagaggccctgggaagcccatgcgaccctgctttctcctcttgtctccttttgtctcttgtcaatcaccatgtctgtgtctctctcacttccagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcccacagtgctccaggcccagggggaacagagacaagaacccccttccttttctgccaggagggtgagccccggctgctgctgctcaggcctggcctgtggcttctgctgctgcagcttcccccatgggtccagggatatccagggccctgcctgagagtggaggctcctcctcccctgagtcctcagagtcaggaacagggtgtccagaaaacaaaagcagggtgtcctgctccctgtagcttgggacacagggtctctgcactgaagtcctgggctgaggtggcaggtccagctgtgtcatcacagacccacttctgttggggaacctgtgtctccatcatcctactttttccatttccaggagtttccagagtggtgtcttcctcccccttctcctcagtgtgaatccctgtgcttcctttctctccagcctattctttttttaataaaactcctttcatgtaggaataatgcacatataataagccacccatatttacaatagggaatgagacaaattttggcatttctatggatccttgaaaacatcaccaccaccgggagctatacaacatacaacctgtgaccaaccccaatagctcctcatgacccttgtcacctcattccctcccccaacaccctccttggaagttgcagatctgcctctgtcactactgtttggtttctcttttctggaatgtatcagtgttatcaaacattatcttcccatttgttcaggcttctttcactctgcacacttcttttgagattctcgctgttgttgctgcattgtacccatctcgtagagggctccttactatctttgaaggtccttaggccatttttttctgattttatttatgtatttattttaaagtttgaatttattgtgcatccaaatcaaactttaggggcaatgttcatctaaggtgacaggacagtctgtgatggcttgtcgggattcttgcttcttcatctcttgcttctgattctctctatagtggaagaggttctcgtctttcatttatttatatatttatttatttactgatttatttgggtttttaagggttttagtgatttttctctttttggttatttttcaatttttttattttaataggtttttgggggacaagtgttgctttgtcacataaataagttctttagtggtgatttctgagattttggtgcactcatcacccaagcagtgtacactgtacccaatgagtagtcttttattcttcacccccctcctaccctttctcctgagtccccaaagtccattgtatcattgttatgcctttgtgttctcatagcttatctcccactgatgagtgagaacatacaatgttttgttttccattcctgagttactgcacttagaataacagcatccagttccatccaggtcgctgtgaatgccattattttgttccttttatggctgggtaatattccatggtatgtgtatgtatacatcacatttgctttatccacctgttgatttatgggcagttgggctggttccatgcttttacaattgtgctgctataaacatgcgtgtgcaagtatcttttttgtataacgacttctttttctctgggtagatacctagtcgtgagattgctggatcaaagggtacatctatttttatttccttgaggaatctccacactgttttctgtagtgactgtactagtttaccttcccaccaccagtgtaaaagtgttttgttttcaccacatccatgccaacatctattattatttttattttttgattatggccatttttgtggtagtaaggtggtatcacatcgtggttttgacttgcatttccctgatcattagcgatgtcaaacatttttctatatgtcttttgtccatttgtatatcttcttttgaaaattgtttattcatgtctttagtccatcttttgatgggactgcttattttttttcataatttgtttgagttctttgtagactatagacattagtcatttgttggatgtatagattgtgaagatttgcttccactcggtgtgctgtctgttagctctgctgattcttttgctgtgcagaaggtttttagtttaattaagtcccatctatttatctttgttcttgttgcatttgcttttgggttcttggtcatgaagtatttgtctaaagtaatgtctagaagggtttttttaatgttatcttctagaatttttacagtttcaggccttaaatttaagtctttgattcatcttggcttgatttttgcataaggtgagagatgaagatccggttttattcctctacatttggcttgccaattatcccagcaccatttgttcaataggatgtcctttttccactttatgtttttgtttgctttgttaaagatcagttatttggctccatttctggattctctattctgttcctttggtctacgtgcccacttttgcaccagtaccttgcagttttagtgactgtgagtcaaattatgctagagtatagtttgaagttgggtgatgtgatgcctccagatttgttccttttgcttagtcttgctttggctatgcaggtcttttttggtttcatatgaattttaggattgttttttccagttctgtaatgaatgatggtgatattttgatgggaactgcattgaatttgtggattgcttttggcaccatgatcattttcaacatattgattctacccattcatgagcgggggatgtgtgacatgattttttcagcagtgttttgtagttttccttgtagaggtctttcacctccttggttgggtatattcctaggtgtatttttttgcagctatttgtaaaaaggtttgagttgttgatttgattctcagcttgttcactgttattgtataacagagctactgatttgtgtgccttacttctgtatcctgaaactttgctgtatttatttaccagttctttttttttttttttttttttttgagatggagtctcgctctgtcgcccaggctagagtgcagtggcgcaatctcagctcactgcaagctccgcctcctgggttcacaccattctcccaccttagcctcccgagtagctgggactacaggtgcctgccaccatgtccggctaattttttgtatttttagtagagacggggtttcaccgtgttagccaggatggtctcgatctcctgactttgtgatccgcctgcctcggcctcccaaagtgctgggattacaggcgtgagccaccgtgcctggccatttatttaccagttctaggagatttttggatgagtctttaaggttttctaggtatatgatcacattatctgccaacagcaacagtttcacttcctctttaccaatttggatgtcctggatttgtttctcttgtctgattgctctggcttagacttccagtactatgttgaatagaagtggtgaaagtgggcattcttgtcttgttccagttctcaggggaattgtttccaacttttttttcctttcagtataatgttgactatgggtttgaaagagtgggcttttcttaccataaggtatgtctcttctatgtcaattttgcaaaggcttttaaccatgaagtgatgctggattttgccaagtgctttttctgcatgcattgagataatcatgtgatttttgtttttaatgctttttatgtggtatatcacatttattgacttgcatatgttaaaccatccctgcatccctggtatgaaacccacttgaacatggtggactatgtttttgatagctgttggatttggttagctagtatttcatttattatttttgcatctatgttcatcagggatattgttctgtagttttcttgttttgttatgtccttccctcattttggtatgagggtgacactggctacaaagaataatttaggaagaatttcctctttctccttcctgtgaattagtgcattagtcagggttttctagatggacagaactaatggaatctgtatatatatagcatgatcacaacatcccacaataggctgtctgcaggctaaggagcaaggagagccagtccgagttccaaaactgaagaacttggagttccatgtttgagggcaggaagcatcaagcataggagaaagttgtaggctgggagcctaggcccatctctcttttcatatttttctgcctgcttattttctagccatgctgttagctgattagattgttcccacccagattaagggtgggcatggctttcccacccactgactcaaatgctaatctcctttggcagcaccctaacagacacacccaggatcaatcctttttatccttcaatccaatcaagttgacactcagtattactcatcacaagtccaccccttgtcaacttcaacccatatatatcttctgagatcatacataatcttcaaataaagacaataataaggtcataatgacacctaacataatacaactatcattcatacaaacagaaacacatcaatccccaacccaaatactgttacataaagttaacgatacttaaacgctgatgtgaagtcaataaatcttatgtcacatgataaaggagaaaggaaataacatgaagatattttcttaggacaaaggtatacacgcacaaacatgtttttaacaaaagaaggaggaaatactcatgacaattacactcctcgtttctgcagctggccatagctggtattgatgattactttcttctactatccattctgtattctgtattccctttgccttcagcaagcacctcagcaggtcgtggatatttttccagatggtgtgatccaaatcttcattcctgaagcatctggttcatttgtagtcctgcctggatagggctgttttagttttccatggaccttaatcacagggcatgataatactaagaaatgccctaatggatctcctgtattccatgcatactcttccttacctccgttatggagtagtaaactgatttcatcttgatagtctgtcccaaacaccccagccaacactgtaactcccttcttagcctgttgacttaaaggtaggaggagcccaaagtgtccaggtggcaatcttaacttccccagtttaatggaatcattgatgtgtctccaagtggcagtgttccttcctctggaactaaatcctctaagccagcagaacataatgtcgtgggaacaggaagcaaaaattttgctagtggatcactaggggtgatggtgagtgctgccacttccacttccaccccttgattcctagactcatgaatcctggctatgggagaaacagtgccatatattggatgctgactcagagcatacacgccttctggggaacttagccccagcactgcaaagtattgtcacctagttgacattgtaattgtgacttcaaaaggccattccattgttctatcaatccagctgcttcaggatgatgggaaacatggtaagaccagtgaattttatgagcatgagcccactgctgcacttctttatgaataaagtgagtgccctggcgagaacaatgctatgtggaataccaggatggtgaataaggcattccatgagtccacggaggatggtagtcttacaggcaaacccatatctggaataagtgtctatatcagtgaggacaaacctatgcccttctcataatggaagatttccaatataatcaaccttctaccagatagctggctgatcaccccaaggaatggtgccatatcaagggctcagtgttggtctttgctgctggcaaattgggcactcagcattagccatagctaggtcacccttggtgagtggagagccagttcgagttccaaaactgaagaacttggagtatgatgttcaagggcaggaagcatccagcacaggataaagatataggttgggagggtaggccagtctctcttttcacatttttctgtctgcttatactttagccatgctggcagctgattcgattgtgcccacacagattaagggtgggtctgcctttcccagcccacttactcaaatgttaatctctttcagcaacaccctgaaagacacacccaggatcaatactttgtatcctttaatccaatcaagttgacactcggtattaaccatcacaattaatgtcataggattagtactaattcttctttgaatgtctgatagaattcaactgtgaatctgtctggtcctggctttattttgttgattttttttaaattaccatttcaatcttgctgcttgttactggcctgttcagagtttctatatcttcctcatttaatttgggagggttgtatacattcagaaattgatccatctcctctgggctttctagtttatgtgcatagaggtaatcagagtagccttgaataatcttttatatttctgtggtatcagtattaatatcttctgtttcatttctatttgagcttatgtggatcttctcccttttcttggttaatcttgctaatggtctattaattttatttatcttttcaaagaaccagttttttgtttcatttgttttttgcattgctttttgtttcaattttatttagttctggtctaatcttcgttatttcttttcttctgctgggtttgggtttgccttgttcttgagtctccatttccatgaggtgtaaccttagattgtctatttgtgctctttcagactttgtgatgtatgtatttaatgctaaacattcctcatagcactgcttttgctgtatcccagaagttttgataggttgtattaagatttactacaactgcaaccttactattgaacaatagctttttaattcctgagagtgtgacctcatttatgcccaaaaacaactttatgattgcttttcatgcagtaggccatgattagagagggagtgcttgtggcctggaggtagggttctccaatttatcaaataaaaacattggagtgcagttaaatttgaattcggtaaaacaatgacaaagaattagtatgtgtatctcccacatgatattgttaaattgaaatacaaatttacctgggtgcgctgtagtttatctaccaactcctcacaggcttcgaggcttggaagaggcagtgttggggctggtctcctcttactgatgccaggtctatgagctgaacctcaaaggcagagtctctctaacacagctaccctccagtgagcatgttagttagcactaaatacaccatatacgatttccaatgaataacacctactcacttccctaattcttctttctattattctccaagtctgcagactcaggacctccccaggggttgctgcagccagagctctggatgagggacctcataagtctttcaaaaccagatgcaaggggactactcggtccccacacagtgaggtttaagccaggggtgcataagcaacatgtaagagacagaagagctcagtatggctcttatggctctccttctgtccagtgagaaaactccagggtccttttgatgctgaaggtgggtgggctgagagtaggaggagacccaccctgacagcccagagattccaggacaagacttggcagcctgaaaaggggccacactcttgagtggggaagaaggaggcaactctgctcacaggcgtgcatttctggtggcttcccctttaccaaactggactccctactctgatgtctatcagagaatctccctcagtgagaccaagatcccaggacattgctaaaaacagcagcatggaccagacaggtatgtcatggtacaggaattctttgcagagcaataaatacaactgcagcttaagaggggccctcatagtcataactttggtgaagaagaaaatagacaaaggcagggagaaactgaagggctcaataggtctgagactggggcagcactgggtgctataggcttgtccttgaggggctgcagataatgacagctgggaagccatcatctgttcactgctcactgggctcagcagctgtgtcctcacagggaaccagattcagccaacctggctttctccaccccacctgggaaatgtattccggtgactgtctggactgaggttctatgaaggggctaggagacaagaagagggagacaggctggtttgcataaagaaagcattgcacaccctttcctttcatctaaaactcattaatggaaactctggggccatccatagaagtctagctggtctcctaaatttgggagttatgaaggattcattcctgatcaatctacaggaagggccatcagcaggaggtggtcagagtgagggagaaactggcttccttgagagactcttcaacacaaccaccaactctggggcaaatggggtgacttgctataacagtcatcccaaactactcacaggaacctgagcctagtcccctcaccttattgcttctgattctggtccatgcctctgttttccctggaccccttgcccatgtctgagtccagagtggcagggatggttccatcccagtcaacatctacaaagaagtctacatctacagctactatgacttgaagcagagtccacagttgtacccaagagggcctcttcagctcccccaccccttcacacaggtgacctctactgtaggtctggttgagtggcccctggaccctggtgaacacaaggtatttattcctctctaacaccaggtatatagtggagcaggtctgggtgggtatagagcagagtgtctcttccaaatgtaatgcagtaagaccctggctacagaaaatcatttcacaaaactccacgccctttcatggtaaaaacacccaatgaactatgaatagaatgaaactacctcaacacagtaaagaccatctatgaaaatcccacagctagtgttggccgggctggtctccagctcctaacctcgagtgatccgccagcctcggcctcccgaggtgccgggattgcagacggagtctcgttcactcagtgctcaatgttgcccaggctggagtgcagtggcgtgatctcgtctagctacaacctccacctcccagccgcctgccttggcctcccaaagtgccgagagtacagcctctgcccggccgccaccccgtctgggaagtgaggagcgtctctgcctggccgcccatcgtctgggatgtgaggagcccctctgcccggctgcccagtctgggaagttaggagcgcctcttcccggccgccatcccatctaagaagtgaggagtgtctctgcccggcagcccatcgtctgagatgtgcagagcgcctctgccccaccgccccgtctgagatgtgaggagcgcctctgcccggccgcgaccccgtctgggaggtgaggagcgtctctgcccggccaccccgtctgagaagtgaggagcccctccgcccggcagccaccccttctgggaagtgaggagcatctccgcccagcagccgccccgtccgggagggaggtggggggccagcccccgcccagccagccgccccgtccgggagggaggtggggggtcagccccctgcccggccagccaccccgtccgggagggaggtgggggggcgcctctgcctggccgccccttctgggaagtgaggagcccctctgcctggccaccaccccgtctgggaggtgtacccaacagctcattgagaacgggccatgatgacaatggcggttttgtggaatagaaaagggggaaaggtggagaaaagatagagaaatcagattgttgctgtgtctgtgtagaaagtagacatgggagacttcattttgttgtgtactaagaaaaattcttctgccttgggatgctgttgatctatgaccttacccccaaccctgtgctctctgaaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgcggaaggccacagggtcctcggcctaggaaagccagagacctttgttcacttgtttatctgctgaccttccctccactattgtcctatgaccctgccaaatccccctctgcgagaaacacccaagaatgatcaataaaaaataaataaataaataaataaataacaaaaaaaaaaaaaaagaaaatcccacagctaacatcatatgcaatctgaaagaccaaagaggtttttgtaatatcaggaacaaagcaataatgcacactttcaccagttctattaaaagcagtattggaagacctggcaagagtaattaggcaagaaaaagaaataaacagaataaaaattagaaataaaaaataaaatctctgttttcagatgacataatgtcatatgtaaaatgcccttaaaagtcccacaaaaaattattagaatgattaaatgtattcagtaatgttttataatacataatcaccttgtaaaaacatctcatggctaggcatggtgactcatgcctgtaatcccagcactttgagaggttgaggtgggaggatttcttgggttcaagagttcaagaacagcctgggaaagaaagcaaggctctgtctctaagaaagcggtggggggtggggggaagagagaaagagagagaaagagagagaaaagaaagaaagaaaaagaaagagagagaaagaaagaaagaaaggaaagaaaaagaaagaaagaaagaaaatctgttataattctatacttaaataagcaaacaggaaacaactcaaaatgaaattaagaaaagaaatcaaattacaacatcattcgaaagagtaaaatacggctgggcacggtggctcatgcctgtaatcccagcattttgggaggttgatttgggggtatcacctgagattagaagttcaagagtagcctggtcaatatggtgaaaccctgtctctactaaaataaataaataaataaataaataaataaataaataaataaataaataaaatttaaaattagctaggtgtggtggcacatgtctgtaatcccacctgctcggggttgaggcacaagaatcactcgagtatggtaggcagaggttgcaatgagccaagatcctgccactgtactccagcctgggtaacagagtgagacaatgtctcaaataaacaaataaataaagataaacgagtaaaatacttaagaataatattaatcaaaatggtgaaagacttgtacattgaaaactataaaacattgcaaaaagaaattaatacacaaataaatggaaagaaatcctttgttcatttattggaaaactcaatattgttaagctaggcatacaaaccaaaaggaatctacagattcattgcattctctatcaaaattccaagttagtatggagatcattaaaaagtcaggaaacaaaagatgctagagaagatgtggagaaataggaatgcttttacactgttggtgggagtgtaaattagttcaaccattgtggaagacggtgtgatgattcctcaaggatctagaaccagatataccatttgacccagcaatcccattactgggtatatacccaaaggattataaatcattctactataaagacacatgcacatgtatgtttgttgcagcactagtcacaatagaaaagacttggaaccaacccaaatgcccatcaaggatagactggataaagaaaatggggcacatgtacaccacggaatactatgcagccataaaaagggatgggttcatgtcctttgcagggacatggctgaagctggaaaccatcattctcagcaaactaacacaggaacagaaaaccaaacactgcatgttctcacttataagtgggagttgaacaatgagaacacatggacacagggagggtaacatcacacaccggggcctcttggggatgggagctaggggagggatagcgttaggagaaatacctaatgtagatgatgggttgacaggtacagcaaatcaccatggcacgtgtatacctaggtaacaaacctgcacggtctgcacatatatcccagaacttaaagtatatattttttaaaaagtgcaagccaaacaaacaaacaaaaagaatagaaaaaaattaatcctaaaatttatatataatattgagagaatctaaatagtcaaaatcatcttgtaaaagaagaacagtgttggagatttcacaccgatttcaaaacatactacaaagctacactaatcaaagcagagtggtacatatagacagacatactgacaaataaaacagaactgagtgcctaaaaaaacctcttagttatacagtcaaataattttaaacaaagttgtcaagaccatttagtggaaaaggacagtctttttcacaaatactgttgagaaaactggatattcaccagcaatctggaaatggatgaaagacccaaatggaagagccaaaactgtcaaaatcttaaaagaaaacattagggagaaggttcataatatagggtttggaaatgacttcgttaatatgacaccaaaggcacagaaaaaaatagaaaaagaagaatatagataaattggattttatcaaattgtaaaacttatgggcatcaaaggacactatcaaccgagcaaacatttgaatcatagaataggaaagattgtcgcaaattttgcatctgataagagatgcagactatagaaagaactcctaccactcaagagtaactacaaaaatgaaaacaatctgaattatatgggcaaaaaacttgagttcgtattgagtagactccaaagaagatctacaaatgggcaataagcacatggaaagatgttcagcatcactaatcattaggccagtgaaaatcaaaccacaataatatacaactccacacccattaggatggcattaccaaaataatagaaaataacaagatctagcaaagacgtatagaaattataactgttatgcattgctggagggactataaaatgatgcacccattgtggaggtcttatggcatttccccaaaaaaattaaacgtagaattgccattttatcggaattttcagttctgggtatgtgcctcaaataattgaaagcaggatctcaaagagaaaattgtacacccttgttcatagcagcgtcgttcacaatagctaaaaggtggaggcagctcaagtgtcatctaatggataaacgggatacagtatacacacacaagggaatagtattcaaccttaaaaagaaagttctgctattctgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtctcagtaaactattgcaagaacaaaaaaccaaatgccgcatattctcactcataggtgggaactgaacaatgagaacacatggacacaggaaggggaacatcacactctggggactgttgtggggtgggggtaggggatagggatagcattgggagatatacctaatgctagatgacgagttagtgggtgcagcgcaccagcatggcacatgtatacatatgtaactaacctgaacattgtgcacatgtaccttaaaacttaaagtataataataataaattaaaaaaaaaaaagttctgactcatgcgatggcattgatgaaccttaaagacatcacgccagcagaaataagctggcttcaaaaggacaaatattgtttgcttgcccttatatgaggtatctagagtagtcaaatccatacagacaagaagtagaatgaagttttccaggtgttaagttttggtttgggaagatgaaaaatttctggagataaatggtggtactgtggttgtacaacagtgttaatttacttaatgacactgaagtatacacttgaaaatggttaaaataatgaattttgcatttgaataatttaccactgtacaaaagaggaagatttatattcagtgtagtttctctaccaagaacaatcaaaacatacaggattgggagagtgtgcctgagtattaggacacccttccttttatgccagcctgcagcttcctaagaggccaatagagttggaagcgcctcattactggtgactcaaagtaatgtgagaaagtctgggagtgaccatgatgtaagtggtgggtgtctgacccagcccaggagcagccgcaaatgcagcagctgccaaaaagggggagatgaaactgatggcagcagtaacagcctctccagctggagtggggcatctgctcttgtgcaaaatggttcacagttgatacatttagcacagaatctcatcctgtctacctgtcatgatcaactacaatttttattgcaaagtatgccatcagagtggcatattttatccagcagcaagcaaacatgaaggaagtttcccttagtgctttggtcaaactggcatggcagtcctgaacactgaatgaatatccaaagacaaggttctccaaagataaagatattatactatttattgataaatactgggagtgcatgatgaccattcagacacctgggaaaatgacttggctgaataacattgttaaaacaatgagtaaaaaaagagatgtgctcttggtaaaggaacacctggatccagggtataaagaccggaaagaagactaccgcagatttggacttttggatcaggacttggtaacattgaccctgtttacgacaaccaaaaacaaagcagtgctgtgtctacagtgggaatctgagtcaggaaactgcagcaggaacagcagaaaaaaggaagaggagctcagtgcaaacagaaggatggggagaccacagggaccaccaagaaggcccagagtgactttttgttttccgctcagggctgtcctcctcacaccccttggatcacacatttaatgaagacggctactggtatagtctaacttagcctgatcctcacacggttggtcctcagaagcttgaaattaactgctgggcaggaaaacctattcctggagacctctacagtgactgcttctatgaacaggttttgttagatcaacatgattaagctccccagttagagatctccagtgactggctggctgactgtggttggaaagaaggtctactttatggtgcagacctctcatgggatacggaaagggtcctggtactttgaaatcaccatgaatgagatgccaccagacaccactgccagactgggttgatctcagccctaaggtaactatgaagctcccttaggttatgataaatttagttattattggcagagcaaaagggaatcaatttccaccagtccactggcgaacactactgttttagctatgggcagggagacatcctacgattttatattaatcttcctgaaaacccaagagacagccaagttaccaagataaggctttgataaagttcaacaattatttttattttgtggaaaaagactttgtggctaaagcagggaagagtctaaaacagattccatatagtaaaataatattttataaacatggtgtcaatcaagatgtggcttcaaaagatatttttagggggttacttttagccatctcactggacaagagcttcatagtttccattaactttggactgtgctccaagtatcctccaaagaatctcacttactgccctgtgagtgacatgggctgggatgctgtggtagagcacactctggctgatgtcttgtattttctggagacaaaagaggatgggggcacagtcctccatgggaaccctgaacaggtccttctttcttttcagatatggactttctggggaataatattgggtggcttttgttgttgttattgtttttgaactgtcttaaatgttctcccaaagatgctacagaacatagcctatccatttaccaagttaaaaggctgagtaggactgtgagagatgccctgctcatcatcattcttcttccacttccagtgactgctcttatattctttgccataagccaacaaccgctcatcccaagatctcataatccctctgtaaaactgatgctgtactacataccttgccagctgggacttgtaatcttactgtattttctaaggagtgaataatcttgtccaggtaactaacatatttaaagacattttcttctgtggacactgactccatgccacctgttttccaaagaagtggtgaagctgtttctgagaacacctaaaatcaatggttgtacattccaaaccaatctaaaagtgatttccttttgctgtgggtttggttctattactgatttggaaatatacctttgaacactgagatctctgaaactactagacttctagaagtgtaattgtataagaagtctgtttgcagctttaacaaaatgagaaactcttcccaaattaaagctttctttgaagttaaaaaaaaaagaataatgtgagattggaacctgtgaggtctgaggattcccaagagtactctcaattctgacgctaattgtaacctaagggctccccaacagcccttcacttcttatgattccctagaaaaactcacataactccctgaaacctgtgacatttattgatacaaatttttacagcaaaataatacagattaagataattcaagggaagaggcacatgggcagagttcaggagaattccaagcacaagcacccagttgtcctctcccagtggagaaatagacagtgcttcattttgctcacagcaatgtgtgattctgtgtatgaaacacctatttcctgggtgagccaaccaggaaagctcacccaagcttggtgtccagagggcttttaaggggtggtctgggtgagagtggggttattatgtagaccttgtggatcatcctcaaggctcacttcagtttccattgaattaacaataaaacttaaaccttcaatctttggttattttctttttaaaaattctctgaagtaaattattattaaaattctcacttaagacagctgtttatccaatatgaggctcaatataaacagtttcaaaaagtcagtaggtcattaaaacaatttcttcagtcattcaaaccattcagataaaaattaacaccatgtaatacaaaaattgaattatagtcacagggacaggatttcagcaatggcaagaaaaagtagtgcaaataggaatgagcaaagaatagacaagtaatgggtgtgaattggcctcggaaataccatggtaatgtcaaaaagataaatcaattgttattttgttaaataagtgaaaggccaggcattctcagtccaggaaagccatcacagggcagtctgagtcttctgcatcttaagaagctcaagaggttcaaacttaataaaccctgcacagttgctcactggttcatgtaaaatgctagagcagttgcttcctcccactcagcaaatccacagcacacagtcaccctggtctggcccttcacagtgtagatgccctcagggctaagaacctgagtggttctaaaagtagtaaagatttgcataaagtaccacacaacacaccctctccacatagggagctcagtaggacataaagagccatcagaatccagccccgactctggagccaggagtcccttctaatatcagcatcatggcctggactcctctccttctccttctccccatgtacctcctcacttgctgcccaggttaatagagatttcaaataccagcctttggagggattcctgtgtctccctttctaattcccaacatgtgtctgttttttgtttcagggtcaaattctcaggctgtgatgactcaggaaccctcactgactgtgtccccaggagggacagtcactctcacctatggctccagcactggagcagtcaatgggggtcattatccttactggttccagcagaagcttggccaagcccccaggacactgatttatcatgcaagcaacaaacactcctggacccctgcccagttctcaggctcagtccttgggagcaaagctgcccagacactcttgggtgtgcagcccgagaggtgaagctgagtactactgcttactgcaccatagtcgtgcttggcacagtgacagactcagaagaggaaccgagacataaacctctctaggcccttgtgatatgaagatcatatgatcacgcacaccagctctcaaggcagcctacatgtggaccagccatagaaaggggaaggaaaggatctgaattgattcctatccctgcttaagccctgaagtgaaggaaatgtgagaatgatctgggaagaactggatcaaaaaaaaaatcagaagtttattgctttgtattctaaaaggagcactaacagctggatcagatctaaaggctgaggctaaatgcatttcctccagaaagaagcatcttcaaagtatggggtttctgagctaagagtaaagagaagaaactctacttttgtatatttctaaagtttgttttattgagttactttcaaagcaatacatgcctattatgtggaatcagaaagtattaaaaatcaccaagttctctgcaaagctaccttatcccagataatcaatagaagtacatttcttcatttggatgcattctctcatttttgttgtcaatattttcacaatggttatcaaaccttgtgctcattcctctggttttatacagctttttgctctgtcatttaatgttaatgtaagtagttttccatttatttgaaagggtaaaatatttgagtagttgctaattttatttttatttgaataccaatgaaaaattataatttggggtaattcaaattgcttgtcagacaaagatgtgacattgggctattattaaaatgctcctggtcttctctgtggatttagtgaagtcaaacaaaatgcctgcaattttctatggaaagccttgagtacattatgcctgacttcacaatgcagaaaatagagaaacaagaatttcctgctcatgtttgctggagcataatagattcaggtacgaggaacaacttatattgaaaactacgtcaatgtctccatgcatgtgttagaacagtacttcccaaactctattgtgcatacaaattatctggggattttataaaatgcagattcttattcagtgggtctggagtgaggacacaatctctgcatttctcacatgtgcctgccacacaaaatccacatatatatttgaataataacaagtccagccagcagtggaggctcatatgtgtaatcttagcactttgggaagctgaggcaaaaagattactcgaagccaggagtttgaaaccagccaagagcaacatagcaagatattttctctatagttttttttaaataataaaaaatgaattagccaggcatagtgctgtatgcttgtagccctaagtactaaggaggctgaggcaggaggagagcttcagcccaggagttcaaacctgcagtgagctatgatcatgccactgcacttgagcctgggtaacagagtgagaccttgtctctaataataataagaaaaacgacaacatatccataagactagtatcaaataaggagaatccttggcaggcaagaacctaggagaaatctctgacatagggaatttaccagcttgcatgatagaagaaccccacactccatggagggagatgaccagggaggacagctgcaaagctaggaaaggctcccctttctttgagagcaaaaacaaaagcaaacaaacaacaaacctgaccttccctctggctcctgtccaacactcttactggctcctccttcagcctttcctataatgtggcccatccttaccctctccccttccacatctctgattcctgaattcccttctttgttctctttccctttgctaccacccacttctcccctctaatctcttgagttaattatcaagggctttataacaggaaactcattggcattttttctgcatctgtccttgaagttgacactcatacttttatctctttcttgaacctctcagatatgcttagaactgaagaagcccgaagttgattgattctgttttttcacctcagccagcaccttcttcttctcctttccaggagaatctgtatttctctgtatttccagaattctctgtatttccagtgaatctgtcagacacagtaagtactcttcaaaggtttaatttctgacttcattgttctttgttctcgagatgaacttccttgtcccttctcctaagctacctgctctgtaaacaacttctcccaccagtcccaatctgtaactcacatctcctccttatttagaaagagtcctcttttactccttgctacccattctgtaaactgcccctcccacaaaactacccttcccacatttgccatgccctgacatgcccaaacataccttgtaccataatggactgcctctcccttcccacctaattagccatactcaattttaaacagtagccaatcaggtcagtttagattgtgtggtccaactccagccaatggggacaggacacagaagcagggactaaccacgttagggatgaaaaccccttccctcctttgtttggtgtgctcttgcagtggtcagaagtgcaagcggcactcttctgtagaaataagtttgccttgctgagaaatattttgtctgagtgctcattttccttgcgactctgagctcttgtttctaacaaaatagggggtcatctgggattcccattctcctctgaggaagggcctctgatcacctcttaggaggagatgcatcccactgcttcattgcagtggcctcaggggtaaggaatcaggacccacccagcatgataaataaacccagactctcagcaacacaggaagaaaaggcctacagttaccgtggcgaccaggtaactgtgcacagacaaaggtaagaaaaaccactagggcagtgaagtacttccttagtggtcaggacattctgcaggttgaaaatgtgtgaatgagatgcacaattaagtgcaaagtgagtgtggagtaaagtaaagggtgcaagaaatctctagtaagagaggttgagccccagggaaatggtgcaagaaatctctagtaggagaggttgagccccacgcacactcagcagggaaaggagagcgagaaacctccagtagcggggattgagcctccagggaaaagggtgcaagaaatctttaatacgagagattgagcccccattaacctccaagacgggagtgcaagaaatctctaatatgagagatatgagcccccattaacttccaggatatgaaataccctagtaaaacaagaactacaaagggcaaaggagataacacaattccctctgatagccttctaggtctcatgttaaaatattggagggataatgaaaggactaaacacaagaaaaagcaacaaatgatcaaatatgggaattgttttatttggaccaaagaacctattctcaaaccttcagttttctggccaaggtttggatcaaatgagagttggatttgtcaacttttaatagagtatgtaaatgacaaaagtcctgcttcccaagaggaaatagactctgctgtgtcttggtggcaggggccggtcctcctctacccccttaaaactagtaaggataagccagaaactaattcccctgtaggaactaaggccccacccctgagcaatccatgtgggatcccttagaccatctgcctccaccagatacccctaacttctctcaagcagccacccagacccttcccctgctcacattatgccctccctccttataatcctgactgttagggctgtccccaacctgaacgccctcctgcaagaaggcttcaacgtgagatagagcaatgtaaaaaggatattcaaaacttccctttcccctcctcctcaaaagagtctgccccaatcgtttttcccttaagggaagtgtttctaggaggagagggagttggctttgtaaatgtccccttaactagttcagaggtcagaaacctgagggaagaacttaaaccactattagattatccttttggggtcgtggatcaaattgaccaatttgtaggatcacaagtatacacttaggctgagctaatgtccatcttaagtgttctctttccgggggaggaaagaaccatgatacagaaggctactatgatagcctgggagtgcaaatatcctcccagtcaaaatacccctgcagcagaacaaaaatttctggcccaaaacccccaatgggataataacaatgcagccaactgagaaaacatgaaagaccttagggaaaaggtagttaaagggattcaggaatcagtgcctcaaacccaaaatatttcctgagcatttaatatacagcagggaaaagaccagggagccatggagtttttaaacagactcaaggaacagatgagaaaataggcaggcttaaacataaaggatccccttaggcagggatgttaaaactccattttgttactaatagttggccagatatcatgaagaaattacagaaaatagagacctggaaatatcggcctatagagggaacaagagggcagggagaggagagagaaagactgacagagggaacggagggagccagggagagagggggggagatacaaaggcagaaagagagagagggagggagagacagagaggcagatagatggagaggcagagagacagtgaggaaaagtcagagacccagacagagagggagagaaagagaggcagagggagagaaagaggacgaaacaaatgtttcaaatgtgaaaaaataggtcacttcaaaagagaatgtcctgaatgggaaaaagaaacaaaagtcatatataaaagcagatcagctaatattaaatttctgttaattccagaggcaggaacatatctattagggagagatttaatgctaaaatttggcttaggcctttatattaatcagggaaaatttctcatctccttaaacctactcaccaccacggatgaagagcgtatccatcctgacacatggtcaaaagaagaaaattgggggaaattacagttcctccaatcaagcccaaattaaaaactcctggggaggtagtaaaaaaccaaaatctttcttttgaaagctgagggaataacctcacagaccaaatagccaaacaagctgccatttcctctgaaacgcccatgtttcacctcaccccttgcctttctcccccaaccgccattgccatcttctcccctgctgaaaaggagaaattaataagaataggaaccaaggaaaactcagaagggaaatgggtgttaccagatcaaagagaaatgctatccaaacctctcatgagggaggttttatctcagctgcatcaaggaacccactggagacctcaagctatgtgtgatgcagttcttagagactatggatgtataggaatttatactctagcaaaacaagctacagatagttgtttaatatgcaaaaaaactaataagcaaaccctaagaaaaccatcctttggaggaagaaacccaggaaattaaggccattccaaagcatccagatagattacaccaaaatggcctcaataggtcacctaaagtatctaccagtaatagtggatcaccttactcgctgggtagaagctattcccttttcaagtgtagccaccagtaatgtagtttagacattaactgaaaatattatacctaggtttggattaatagaaaatattgattcagataatggaaactatttccctgcacatgtcattaaaaagctagcccaagtattacaaataagatgggaataccatatccctggcacccacctttatcagaaagagtagaaagaatgaaccaaatcctaaaaagccacctaatcaaactagttttagagactcgactaccttcctattgcctaattgagggtccgaactgcccctcggaaagatattggcttatctccttaagaaatgctatacgggttgccttatttacactccactgctgacattcctacatttgaaactaaagatcaatttctcaagaactatataattggtctgtcttccactttctcttccctcagaactaaagaccttttagcactgacaccacccttggagctcccagcacatcagcatcagcctgggatcacattctcatcaaaagctggaaagaaggaaaactcgaaccggcttgggaaggacactatctagtgcttctaactacagaaattgctgtccgcacagctgaaaggggatggacaccccacacacaagtgaaaggagtgattttcacagcgagagaaaaatgggccgtcaccccagggcccacccgcaccaaattaaaaagggctgaataatcatttgtttattttcccttttctttccaacagaaagtcacctcatcatcagtgtgcctcaaactaatcgtcccttaaccctccagttcgatgcttgttcagtcacctcatgtagagatgaacgagctcaaaggcagctatcaaatgtagataagtatctgtgtccgtaccgtagtgagtcaaccaagtataagtatagagccttaaaaagtccctgtggtgactggacagatgtttggtggaccacccaatatggagggtggacagccaggccccctttttcaaacaattctgaggactgaaacagaaactccaacttattcgtggtaccaccccaccaaattgtaagtcattgcagtgtaaccccttattgctaattatagataatccccaaacaatgacccaagaaccctccatattcgaatgatatgggttaggagcagatgttacaggacaggaccccataggaatcttctttctgaggttggctagaccatcagttaaaaacaataaagaaatccagacccagagtccagggaacctatgggagccaatgctctccccaaacatatcaggctcagcattctcttctcatctccagaatgacccaactaaggtaatggttgtggaggtaaaagatttaaagcagactacagctctagagacagggtacaaagacgcaaatgcctggctggaatggattaaatctcctgtccacactctaaacaaaagcaattgttacacttgtgcacatggcaggccagaggccctgattgtcccctttccacttggaaggtcctccagccaaccaggcatgaactgtatggtagctgtcttccaacaccccacagcctggggtaatgaattatgctgaactctctctctgctatttcctgaagtccagcaccctgtgggtcagcccctgagggccatccagcttctgtctcctgatgcaagtttcaccccatgtctctcacgacaaggggaaaacttagcatttcttggagacctaaagggatgcagtgagcttaagccattccaagagctgatcaatcagtctgccctgatccatccctgagcagatgtatggtggtattgctgcggaccattactagacacttccaagtaactggagtggcacttgcactctgatctaattggccatccctttcactctgacattttgtcaaccaaaaaggataaagacaaagcatcataaaacaaaagatgctcctcatgggtcctttgactctcatgcttatatagatgtcattggagtccagagaggagtgccagatgaatctaagccccaaaatcagatagttgcagggtttgagtccatactattctggtggttgactgtaaataaaaatgtatattggataaattacatctattacaaccagcaaggatttgttaactatactagagatgctattaaaaggatagctaaacagttaggacccaccagccaaatggtttgggaaaatagaatagcattagacatgatactagcagagaaaggtggagtctgtgttatgagtggaactcaatgttgtacttttatacctagtaatactgctcctgatggaaccataacaaaagcattacaaggtcttactgctttatccaatgaagtagctaaaaattcaggaataaacgatcccttcactaatttaatggagaaatggttcagcaaatggaaaagacttatgtcctcaatctttacttctcttgacattgtaataggtttgcttattcttgtagaatgttgtatcataccctgcacctgaggcctactacaaaggcttattgaaacaactctcactaaaacctttttcaaatccaccgcccccccaccttattcagataagctcctacttttagaaaaccaagcagaacaacagagtcaaggcatgttaaaaaggtttgaagaggaagaattataaaaatcaaaagggggaaactgtcagatacagtaagttcctcttaaaaggcttaatttctgaattccttgttctttcttcctgagatcaacttccttgtcccttctcctaagctacctgctctgtaaacaacttctcccaccagtcccaatctgtaactcacatctcttccttatttggaaagagtcctcttttactcctggctacccattctgtaaactaaccctcccacgaaactacccttcccgcctttgccacaccctgacttgcccaaacgtaccttgtaccataacagacagcctctcccttcccacctaattagccatattcaattttaaatagtagccaatcgggtcagtgtagattgtgcagtacaactccagccaatggggacaggacacagaagcagggactaaccacattagggatgaaaaccccttccctccttcatttggtgtgctctcgcagcagccagaggtgtgagtggcacccttctgcagaagtaaatttgccttgccgagaaatcctgtttgagtgctcattttccttgtgactctgagctcttgtttctaacaaatccagtgaaccacacaaatatactagccaattttctccaatccccaccattctgccttatgtgctgatctagtgaggaatcaaataggaagagagacccatggatttctatgcagcctgggaagtgagttcatggatgcactcagttgtaacaccagacacctgtctgccgtttgctgtttagcattcacagggcccagcagctgtgtcctcccagggtgcctggagcatcactgaccacaccctcctacctcccacccacctactcctcaaaaagaaaaatcagactcggcatcttatgtgaggggcacagccaggggtcaggatagatttccactgagtcccctcccctaagagacaccagggaagaggggttgttccgcctaatctatgtggctcaggaagcagagcactacagacatctctaccatggcctggaccctctcttcctcaccctcctgagtctctgcaaaggtggctgtgacatgactctgatgactggagaaacaccagggtcctttgtctcacactgagaaaattagtgacatggacacacattgagtggttttaaggaacagaaagtttaataggcaagaaagaagaaaacagctcccccatacagagggaggagggatcctaatggaaaatcccacatgcaatggaaaacagctgattatattgggaggctggaggaggcagtgtctgatttgcaaagggcccaggggattggtttgaccaggtgtgacattcatgcagcctgtaaaaaaaactggccctcccaccttagccttttaatatgcaaatgcaggtcaccatgatgtcctgcacatgtggcttttatctggaggctgccatgacacctggcacacgtggtgacaaaaagaggagggcgaaagccaccatattgggtggacctggcttctagccaccagcatttgcatatcagtgcttgccagtctggtttttcaagctgctttctgttagcaaagaaatggtttgggggtcgctttttattaaaggaaaattccaccgagaacttacaccatttctagctgcctaaaaattatttcttaatgactcctgttatttcccccctcaggagaagtaaacctaactgtcgttaggggatgttggacaacaattctttctggctacttccttctggaaaggggcgtcatgtaaggggacagcagttgggcctcctcctgaggttgatctaaggattctctgaagaatggcatgtccatgtgtggctctgtctgcagcattatttggagtttgattgcttctaggtgaaaagagataaatcttacaagaaggtttaaaatatagggttagaatatgagtattaagattaccactgttagtgggggtactatagaccacaactatgacagcagagtttgatacttgttagttacaccagtggattgtaatactgggttgtctccactagatgtcactgaatattaccagaaagattaatatgaaagtgacatttttccttgagaaaaccatacatttccccctttacttgccattagtgaatagttttaggcttagaccatttttataacttgcaatataattgggagaaatacattattgggtggctaaattaactttagtgttaatcttgacaattccttttctttaattattaaattatttcatgactttcacagaccctcttacaacatactcaaactttccgacttgtcctaaacatccttcctttaaataaccagtcatttgcttttaggacaagaatttcccacacaagatcttttcttatataaagttccttcttttataaccttctttctatagcttagagtgcaccatacaaccagtcttcaataaaaagtcctatcaaacttaatgatagtaaaactttcatgctatatccataactattactcctgctataagcaaaacagccttgactaaatctttcctgcaattgttaatcctgttataaggatgataattagacaagatgttacagcaattagaattttacaaccagaattccacattgtgagtgccatagtgtatagttctattgcaaatagtagtgtgactgtaacaattcccacaagactggcatagtaaataatttccattgaaaactttacttgccaagatataacatttccctttgggaatctacaaggttacaaatgcaattctatgaataatcaaaatctccctgcgaatatgcattaaaaagaagttctaatatttggtggcaaatttttagaggaaggggtacaaataataaaaagtggccgggcatggtggctcacacctgcaatcccagcgccttgggaggctgaggtgggcagatcacgaggtcaagagactgagaccatcctggccaacatggtgaaaccccatccctactaaaaatacaaaaaaattttgggaggctgagacaggtggattatgaggtcaggagatcgagaccgcctgtagtcccagctgctcgggaggatgaggcaggaaaatggcatgaacctgggaggcagagcttgcagtgagctgagatcgcgccactgcactccagcctgggcgacagagcaagcctccatctcaaaaaaaaaaaataaaataaatagctgggtgtggtggtgcatgcctgtaatcccagctactagggaggatgaggcagaagaatcacttgaacccgggaggcagaagttgcagtgagctgagatcatgccattgtactccagcctggtgacagagcaagactctgtctcaaaaataataaataaataaaaagcatctggtgaggtaggagtgggactgagtaggatgagtagccctcactcagttacttatcttttatgattttcagcttaagatcttctatttctccactttgatattcaggacgttcctctgggctgtcaggggttgctccctcaggcattcaggctttgacttgagtgtgatgtattcagaagttgacacctgtaacttttgctgccaagggggttgaaagagaacagtgtagggcccttcgcagcttggcttagggaaggagagagaggtgagagttttcactagtaccaaatttcctgggttaaataaaggtggttctatttcctggggctgggcttctgccagttgtgtcaatttctgttggaagtgaggtagagaggttacatgcttaaccaatttataggttttctgcctgaaaacagtctctgagcacattgacaaattttatcctttcctaagtgaaaagcttggtgaaggattttaagaactttccattggctggaggctggcaaatggagtttgccatcctctggctgtagccatcctgagagataaaaagcatacccttgagaagtggcctattctgtttctgcaggaaaatactgaggtttaatttctgttatggagcattcctagattagaagggggcttgaagtgtgttaatgccttgaggcttccttgcctttgacttagctgcctgattaatctatttcctttggctactttatttgctgccttttggtgttcctataatgtatccctgctatttctcacggcataaaaagtgaagataatagcctgctaattttctggtgatattttacaggaaatccattagtggtaagaggatgtctttccttttaaatggcagcatgagtatggagagctaagaaagcatacttggagtccgtgtaaatgttggctacctttcccttgcttaattgaagtgttctcgtaagagctattagttcagctaattaagtgcttgtgtctggggagagatgttgtttagagtgactactgcttatcctgccttatgtatttcttgctttaccggctgttagttaaaagcgccccctaaaggacagtaatcctgccacattacgtggggtgtaaacagttaagttctttcccaggattaatttggaggcttttctaactgtaaagctatcatgacaatggcttggaagcatgtgtaaataggtcctcctaactgcaactaaggttgagaaaaatattgtactagagtttttcctgagatgttccttatggtgatgctatgagaagaggggaggcctggattagagagaagaaaagagagagattggctttagtatttagaaggacatctactttccttcaatttccagaatcacccaggtcctggcaccctgttaaatgtgccacccatgtttgcaagcgtgaccctccaagccatggcaccagaggaactaagcttgtgggcctagtcgtgctaccccaagcagctctagtcctctgcctatgatttccctttgacttcctagacttgtgtgatctgtgtgtctcaccccacccccacccccaaaaaaatagatcttggcagaaactatatggaaggaaaggctcctttaatggagggaatgtgctagattgcctgctattatggcctgtgctaaagcatttacccttagaaaaatggttccagttaacttccagacttaaaatctccttactaattaagtactgttttaatcggagagagaacaggtgtcttaaaggaacgcggggacctaatggcgactttcctgctaatgggacagtatcggggcacaaattcggctgcagaggaattttactcctaatagttaaaagcagaattttcccgttcacaggagcagcataaatcctggtttccagtagaaaggtgcaaaaagaaaaaaattgagaagctgcggtgtaccgcggagatcagcaatgtgtcgcataaagaggattttatttccactaggtggcgctgttggcctagaaataccatgtgctcaccagaggaattttagggagtaacctcactgaggggcaaaggaagacttctgttcctagaagattgcaatggcattttcctgagctatctccccagttactacagcattttctgatcttgcctaccaggattacttccctacgctgtaaaaattcccgcacatttgacacacagagagagtaagagacataacgaccacggataaaaaaggaagaaggttctgcgacaggatagctagggatcctttaccaacatccagagcaggccgttggaggctgggtccagtcccgaaacctttgaataacaccaggctgtgccctggccagaaattctcagttgcttcagaacttttcccagcctcacgcgatggctaagtttccccatgaaaagaaactgatttgaagcatgaccaacattcccaaagacccgtgagtattgcgggttctccgtgttctgaccagcaagcctaacactcaagtctttagaacaacagccatgataagcgtatttagacggccaatggatgcccataattgatttgattttgattttaaaatagagaccaagaacctctgaatgacagaacagactttgagttcactcctctaatcactacgtcgatgaatgttgtaccttggattcccagtgaaggcaccagaaaggatacggctctgatgactggagaaacaccagggtcttttgtctcattctgagaaaattagcaacatggatggacatatgtggagtggttttaaggagtggaaagtttaacaggcaagagagaagaaaaacagctcccccatagagagggagaagggctccgaacggaaaaccctacatgtggtggacagcagctggttatattgggaggctggaggaggcagtgtctgatttgcacagggcccagggaatgagtttgaccaggtgtgtcattcacgcagcctgtaaaaaaactggccctcccaccctagccttttaatatgaaaattcaggttgccatgatgtcctgcacatgtggcttttatgtggaagctgccgtgacacctggcacatgtggtgacaaggagaagagggcgaaagccaccatattgggtggacctggcttctagccaccagcatttgcgtatcaatgcttgccagtctggtttttcaagccgctttctgttagcaaagaaatggtttgggggtcgctttttattaaaagaaaattccaccaagaactttcaccctttcttgctgcctaaaaattatttattaataactcctgtagtagctggagacaaggaggcagggatggcactgggaggaccagggctcttccttgctcccctggcttactgagccacctccctcaccctgtgtctctctcctgactctcagggtcctgggcagtcagaactcacttggtaacctgcacagtctgtctgtggctaaaccagtcaccatctcctgcactggaagcagcagcaataagggtcttgggattgtgtcctggtaccaacaatgaacaggaagtgtccccaaacctctgatccatagaagccaatatacacttttagggatgtaggactgattctcaagctatcagttttccaaaaaggccttcctgagcatctctgggctccaggatgagaacaaggctgatcactaatgttggcattagtgatcatgtttgtgatttgctataaaatcatccagcgatggagtaagatgatgggtaaaaagggttgaaagattaaacaagatgagtcacactgatgatgtcaaagctagctgatgggtgccaaggattcattagacaactctcagcatatttatataactcaaaaatttccataataatcactgcctaaaaaaatccatgtctgtgatgagaggtatatgtcctgcttttaattggtatgtaacctgattttaacaatgtggtatataatctgcttttaacaacgtggacaaaatgtaagcttacattctgacttcaagttgaagcccatcttctcctaacaggcaaaggaggagctggggtggaggctatgaaagggaccggagctcagcgtttcccaggacaaagaagtgagtgaggccggagtcccagcagaaggacgaggggctgtgagatgggctatgggagtgtgcaggggccacaacgtgcaggtcatgctgctggggccacaggattcaggttttatataaacaacaaggagccactgaaggtgtttaagccagggagtgacatgccacatctgaatgagaagcatctctctgaattccttgaggagacagtgtctgaaggaagtgagtgacctgattctagattatttactaaagcaccttgtaagtctagaaatccaggggccatttacaattagcacaagtgtagatgtgggctacattgaagaagtgatggtctcttgtcattcttcacagaactagaaaaaacaatcctaaaattcatatggaaccaaaaaagagcccacatagccaaagcaagactaagcaaaaagaacaaatctggaggcatcacactacctgatttcaaactatactataaggtcatagtcactaaaacagcatgacactggtataaaaataggcacatagaccaatggaagagaacagagaatccagaaataaacccaaatacttacagccaagtgatatccaacaaagcaaacaaaaatatagagtgggaaaatgacaccctattcaacaaatggcgctgggataattggcaagctagatgtaggagaatgaaactggatcctcatctctcaccttatacaaaaatcaactcaagatggatcaaggacttaaatataaaatctgaaactataaaacttatagaaaataacatcagaaaaactcttctagacattggcttaggcaaggatttcatgaccaagaacccaaaagcatatgcaacaaaaacaaagttcaataggtggaacttaattaaactaaagagctaaagaaaaaaaagagcttaattaaactaaagagctaaagaactaaagaaatcaaaataatcacttatagaatgatgaaatcggtgtctgggaatcagaacatggatgtgtgaatacagacagtgactggtgagctgcatggcaaaaggaacatcagcagagtaaacagacaacctacagagtggggaaaattcttcacattctatacatctgacaaaggactgatatatccagaatctacaaagaactcaaacaaactagaaagaaaaaaaaaactcatcaaaaagtgggctaaaggcatgagtagataattctcaaaagatgatatacaaatggccaagaaacatatgaaaaaatgctcaacatcactaatgatcagggaaattcaaatcaaaaccacaatgagataccaccttaccacctgcaagaatggccataattaacatataatagatgatggcatagatgcagtgaaaaaggaacacctctacactgctggtgggaatgtaaactagtacaaccactgtggaaagcagtgtggagatttttttaagatctaaacatagaactaccatttgatccagcaatcccactactgggtatctacccagaggaaaagaagtcattatacaaaaaagatatttgcacacacgtttatagcagcacaattcacaactgcaaaaatgtggaagcaaccaaaatgcccacaactcaatgagtgaataaagaaacaatatatatatgatgatatactactcagccattaaaaggaatgaattaatggcattagtagcaacctggatgggattggagacttattctaaatgaagtaactcaagaatgggaaaacattgcatgttctcactcagaagtgggagctggccaggagtggtggctcaagcctgtaatcccagcactttgggaggccgaggcgggtggatcacaaggtcaggagatcaagaccatcctggctagtgtagtgaaaccctgtctctactaaaaacacaaaaaaattagctggccatggtggtgggtgcctgtagtcccagctactcaggaggctgaggcaggagaatggtgtgaacctgggaggtggagctttcagtgggctgatatcatgccattgcactgcagcctgggtgacagagtgagactccatctaaaaaaaaaaaaagaagtaggagctaagctatgagaatgcaaaggcagaagtgttacgggaagtcagggaccccaaagggagggaccggctgaagccatggcagaagaacataaatcgtgaagatttcatggacattcattagttccccaaattaatacttttataatttcttacgcctgtctttactgcagtctctgaacataaactgtgaagatttcatggacatttatcacttccccaatcaatactcttgtgatttcctatgcctgtctttactttaatctcttaatcccatcatctttgtaagctgaggatgtgtgttgcctcaggaccctgtgatgattgtgttaactgcaaaaattgtttaaacaacactaaatctgggcaccttgaaaaaagaacaggataacagtgatgttcagggacaagggagataaccattaggtctggctgcctgagagccatgtggaacagagccatacttctcttctttcaaaagcaaataggagaaatatcgctgaattatttttctcagcaaggaacagccctgagaaagagaatgtgttcctaggggtaggtctctgaaatgaccgctctaggaatgtctgtcttttacagttgtagataagggatgaaataagccctggtctcctgcagcgctcccaggcttattaggatgaggaaattcccgcctaataaattttggtcagactagttgtcttttctcaaaccctgtctcctgataagatgttatcaatgacaatgcgtgcccgaaacttcattagcaattttaatttcactccggtcctgtgatctcgccctgcctccatttgccttgtaatattttattaccttgcgaagcatgtgacctctgtgacccacaccctattcatacactccctcccctttgaaaatcactaataaaaacttgctggttttgcagcttggggggcatcatggaacctgccgacatgtgatgtctcccccagacacccaactttaaaatttctctccttccctttatttctcagaccggccaacacttagggaaaatagaaaagaacccacactgaattatcgggggcgggttcccctgataagaagaatgacacaatggactttggggactcaggaggaaagggtgggaaggagggaaagtggtaaaaactataaattgggtacaatgtatactgctcgggtgatgggttcagcaaaagctcacaaatcaccactaaagaacatactcatgtaaccaaatatcacctgttgatattactcctatcaacattactcctacctgtgtctgtgtatctttgtcatgtgacttatcccccttgactttgtgcttggccctgttctcactttgagtaatggaacatttgtggaccttatgcaagctcaagtttaaatgtccttgcaccacttggtttgccctcttttgcaactctcattactaagatcttgtcctggatagtttttggcccttcaggctgggtttccaaataaacacgtgtgagtaataaatgctgatatttgtgactgttacatagcaatatatgaatgatacatctaacataaagcagacactggatattggtgtggtgagtgaaaacactcaggcttgtatgtatgtagattcctctcccacagagggcagtcatcaatattaccaactcaactaagaggatgattcttatttggtgcagtttctctaattccaagagcagtggagaagtctaataccagggcagtgagcacgaccatctgaacaactcttccttttatgctggccctgacgcatcctaacaggccaagaaacttggaagtgcctccctggaggcagctgggagagtgatgacagatcgggctacgtgggtgatttatttatattcttctattgtctaagatggatatgtttatttaaaattggaaataactgctataattaaagcattgaataaaactaaaattaagaattaaaaatttatatattctccaacatcctatcagtcaaagaaaattacaggtgggtattaaattgtcagataaaagaagaactttcagagcaaaggaaagaaatgaatatttataatctccaagcattgcatgtatattttctctaattctaccatttggctacattttaaggtgccctaaaatttgctttttttttttaaattttctttcgctttccaattctatctcattatcacccatgaagtcccatctttatttttttaacaacaaaatattaggagaaaattaatcatcatttaatccatttatttttatttatttatttttgagatggggtcttgctctgtcatccaggctggagtgcaatggcacaatcacggctcactgcagcctctgcctctggagctcaagtgatcctcccacctcagccttccaggtagctgggactataggtgtgcgccaccacacctggctgagtttttaaaatttgtatagagatggggtctcactgtgttgctgaggccggtctcaaactcctaggctcaagcaatcctcccacctgaacctcctaatgtgctgggattataggtgggagcaataatcatttaatctaaaattctctcagatgagtaggtatgggaaaatttttaaaaaaataataatattaaaataataatataatctaaaacctttttttcacaaatatatctcaggcccaaattttcatccgtccatccatacattcatcaattcattcactcaaccatcaaacatttatttatttatttttttgagacagagtctccctccattgcccaggctggagtgcattggctcgatctccactcactgtagcctccgcctcccaggttcaagtgattctcctgcctcagcctcccaagtaactgggactacaggtgcaagctaccacacttggctaattttttgtatttttagtagagatggggtttcaccatgttagccaggatggtgtcgatctcctgacctcgtgatctgcccacctctgcctcccaaagcgctgggattacaggcatgagccaccacacccagcccatgaaacatttattaagggcccattctgggtgacatattatgttaggttggactgtgagggtataaatacaggacaaatgagaagggttccttctgtcaaggagaacacactcgaagatactagaaataaaatagaaacttctacgctaattactaatacagagaattaccagatttttgaaagctcaactaataaagcaaccacccttttctggatatatcaagaaagtgtctgccttggatgtgggatcttagaaaaagaagagtaagtatggaggaaatgaggtcatctccaacagagggactgtgtgatagtatggactgcatatttctgtctcccccaaaattcttagattgaaaccctaaccccccatgtgatagtatttggaggtagagcctttgtgaaataattaggtttagaagaggacatgagagtggagccctcatgataggattagtgtccttaaaagaagaaaaagagactagatctttctgccatgccaggctacagagaaaggtgccatctacaaaccagaaagtggaccctcgccaagaaccaaatctgcaggcaccttgatcttagacttcccagcctccagagctatgagaaataaaggtttgttgtttaagccatccagtctttgctattttttttatggcagcctgaactaagacagcctggcaaacacaggaaaggaagctataaaagggcacaatgggctgggtgcagtggctcacgaatgtaatctcagcactttaggaggccgaggcaggtagatcacttgaggccaaggagttcgaaaccagcctggccaacatggtgaaactccatctctacagaaaatacaaaaattagccaggtgtggtggtgggagcctataatcccagctactcaggaggctgaggcagaagaatcactttagcccaggaggtggaggttgcagtgagccgagattgctccactgcacaccagcctgggcgacagattgagactccgtctccaaaaataaaaggcaccaatgactgtgtgttgagtgaccaattgtgttgagccatagaggaaagatgtaggcaccagtgacttgtccaggatcagggatgacacacttctttttcttgatagctattctgtcctctcccagacattttttttttttttttaacactgctgtcgcccaggcaggagtgcagacatggctcattgcagcctgaacctcctgggctcaaatctcccacctcaggctcccaagtagctgggaccacaggcatgtgccactatgcttggctattttttttttttatgtttcgtatagatagggtctcgctatgttacccaggctggtcctgaactcctggcctcaaatgatcctcctgccttggcctcccaaagtgctgagattgcaggcatgagccgcctcacctggcccctctcccaaactttcttttgaggttaaataatgtaaaaaggaagagtgtgtagaacaaaagtaatagctaatgtaaaaaaaaaagtttaaaacaaaaattatccatatctcactacttagagataaccattatatatattttgacaacaaatacccttctggatttctgcatttgctctgtcagatgttagttgaggtgggacagggaaaggggttaagggaggaggcaaggaaagaagggtcagaatgcaatttatcttacgaggcgttttcccatttagtaatacataatcaacatctctgcatgttttcaagtatataaagctccttagatcattacttattcatagtattacagggattctatgttttctctattataaactacatgttgttgaacttctttcaaactacatctattcatacagcaagtcatttactttgtaaaaattcctaaacttaaatatctggttcaacacaagtatgcaaaattttgtacagattttatttaccatagaactatggctacaaattaaatgaaaataatagtaataaattataataatataggagtcacctcacagatgtttccagtcacaaagtaaggcttttcctgctttgtacttaagttgaaatccccccaaagtgcataaaggcggatacatcctttctagggtacccttttcaccctgtagatgaaccctgacgtggccaactgatctaccgacagtagtacactctagatgtcttttattaaaataatagataatagagtaatccacaaactaggaccttacacacatacgcacagagcaaaagctcctgaggtgcagagcctacaggaaacctcatcaaaagctctgatggctcctgtcgatgagcacctttaggaggggctgctgttgtcttaagtcagaacagagatagtttgtgcctctccattttgaaatgctccagatttcccttccctgtcttggtctctcagagcctaatgtctgtgctggactagcatagtcagtctttggttatgtgtctgtattttctatttaaagtagtctaggctgggtgcagtggctcacacctgtaatcccagcactttgggaggccgaagtgggtggatcacaaagtcaggagttacagaccaccctgaccaacatggtgaaaccccatctctactaaagatacaaaaaattagttgggcgtggtggcgaatgcctgtaatcccagctactcaggaggccgaggcaggagaatcgcttgaacccgggaggtagaggttgcagtgagctgagatcacaccattgcactccagcctgggaaacagggcgagactccatctcaaaaaaaaaagaaaaaaaaaacattagtcggggtggcggcgggcgcctgtaatcccagctactcagaaggctgaggctggagaatcactgaacccaggaggcagaggttgcagtgagctgagattgcaccactgcactccaacctgggcaacagagggagactccgtctaaaaaactaaaataaaataagatactctaaagtaaattatttaaataattctcatcttaagcaagcagtttattcagcatgaggttcaaagtaaataacttcaaatcagatggtcatgaatataacttctttagtcattcaaaacactcagataaacaagacggataacactgaaatgaaatacagacaatgcagtggattttcaacaataactacaaaaaggactgaacaaagagacaaacaatgaatgtgggcttgcctaggaaatacagtagaaatgtcaaaaaaagttaaatgaatgagaggggtactacaatcctccaccccaggaaaccacagcaaggtgccgtggatcctctctgaagcctgacgttcaggttgttcatattttaggtaccctggacacttgctcataggccctgcaagaggttacagcagctgttccctcccacagggcaaagccagatctcacagccacctaggcctccccatgacagggagttgctccctgggacaaagaccagaataggaggaggagggagagataaaaggctcagatttgcataatgtgtcccacaaatacctaacctttatgcaagaggtgaggagggcataaaagagccattagagagtccaacactagctgtgaggccagtgggcccttggaacttcagcaccgtggtctagactcctctcctcctcctcactcagtcactgcccaggttcacagagatttcagatcagcctttagaatgattcttctgccttcttttgggagaaagtgggtctaggaaaaatagaatgcaaatatttttccaatccatagggaacaataagaggtatactagatgaagagtttatggtcaaatattttttcaaaaaaaaaatctctctatgatgtaattctgactgataatagcaaagaaaacaagctccttattttatataaaaaatttttctttttttttttttttttgagatggagtcttgctctgtcacctaggctggagtgcaatggcacgatcttggctcactgcaacctccacctcctgggttcaagtgattctcctgcctcaacctcctagggattacaacctcctagtagctgggattacaggcagccgccacaacgcccggctaatttttgtatttttagtagagacagggtttcaccatgttggtcaggctggtctcaaactcctgacctcgtgatccgcccgcctcggcctcccaaagtgctgggattacaggcatgagccaacgcgcctggcctaaaaaatttttcaaaacaatgcaagtttactacataaaatctggctttttttttttttttttttttttttaatgatgtggtcctgctctgtcattcaggctggagtgcagtggcacaatcactgcttattgcaggcttgacctcccaggttcaagctatcctcccctacctcaatctcccaagtggctgggaacataggtgtgtaccaccacacttggctaatttatttattttctgtacagcctggatccccctgtgttgcccaggctggtcttgaacttctgggctcaagctatccttcctcctcagcctcctaaaattccggaattacaggcgtgagccaccatgcccgacctagaagtatttgtttcaaggagcatatttaactacgccgtaaagaccaaatagttcagaagttagatgttacaattttagtctcttctcctacttcttcttttttttttttttttttttttttgagacagagtctcactctgtcacccaggctggagtgcagtggtgcaatcttggctcactgcaatctctgcctcctgggggggtcaagcaattctcctgcctcagcctcccgagcagctgggagtacgggcatctgccaccacgccggctaatttttgtatttttagtagagacggtgtttctccacgttggccaggctggtctggaactcctgagctcaagtgatttgccccgcctcggcctcccaaagtgctgggattacaggtgtgaaccgccgcgcctggctgttctttcacatattttctccatagttcagatcacaatgtatacaaatttttttcctgctagttttctttcacattactgcaatctatctcttttaaaaaaagtatatagtgcagctatttcagccaggcacggtggttcatgcctgtaatcccagcactttgggaggcagaggcggctgaccacttggggccaatgagtttgagaccagcctgggcaatgtggtgaaaccccatctctactaaaattacaaaaaaataattagccgggcgtgggggcccgcggctgtaatcccagctcctcaggaggctgaggcaggagaatctcttgaccgcaggaggcggaggttgccgtgagccgaaatagtgccactgcactccagcctgggcgacagagtgagtgaggctccgcctcaaaaaaaaaccaaaccaaaacaacaataacgaaaaacaacaaaaaaagtagattgtgcagctatgaaatgaaaagtacaaaactgttcagtttccaggcatttaaaattatttctggccaggcctggtggctcatgcctgtaatcccagcactttgggaggccgaggtgggcacatcacctgagatcaggagtttgagactagcctgaccaacatggagataccctgtctctaactaaaaaaaaaaaaaaaaattatttctactttacatttacattagtacaaccaaagtattgatgaattatcttacatactcaattttggatatatacataaacattcattctgtaaatttttattggatatgttaaaagcatcccatgaggccagcagtggctcacgcctgtaatcccagcattttgggaggccaaggcaggtggatcacctgaagtcaggagtttgagaccagcccggcctacatggtgaaaccctgtctctactaaaaatacaaaaaattagccgggcatggtggcaggtgcctgtagtcccagctacttgggaggctgaggcaggagaactgcttgacccctggaggcagaggttgcagtgagccgagattgcgccattgaactccagcctgggcagcagagtgagactttgtctcaaaaaaaaaaaaaaaaaaagcatcctatgaaaaaaatgaaattattacctttttattcatatattgaaataacttccaaaaaggcttatgccaattgaaactccttttaatacatcctcactgacagtaaacattacaatttatataatattcatcagtacgctaccattgctttaattcccatttttgtttttgctatggagactaaatattttgcatttatttaccaatcagctatatttattctttgtgaaatggacagggatttttttctttacaacaattttataatagtgcattagagatttgtcttagtaatctttttttttttgagatggagtctggccctgtcacccaggctggagtgcaatggtgcgatctcagctcactgcaacctccacctgctgggttcaaataattctcctgcctcagcctcccaagtagctgggattacaggcgcccaccaccatcatgcccagctaatttttgtatttttagtagagatggggtttcaccacattggccaggctggtctcgaactcctgaccttgtgatctgcccaccttggcctcccaaagtgttggaattacaggcgtgagccaacacacccggcccccgatttttcttagtaatctttggaaacacttcagaaatatttttaattagccctttcataatctcaggctataattttcctgtttatatgccataaaatgtgaacatgttacaccgtcaaataaaaaaagcaaggtgcagaagactgtgcataatataaatcagttatttaaaaaaaagaaaagaaaaaataagaaactatctgaaaggctaaaaaaagaatctgagttgttactttttcgatgtttgaagaatgtgaatatattatatactcaacattttaaaataaatgaactttaaaaagaatcctctcaaaatggtgtcagccacaatggcacaccagagagtgggaaggcaacacaatgaccattaactcagttttagctgccttccttgtatcataaaaacttctaatgttccattttccctgtggtaacttccaagatggcctccagtgattccccaccctctggtattcctatctgtatatggtccattcccacatagcatcagggttgctctgggtgaccaagagtatacaacagagtgaagttattttacctccaaggctattataaaaaacattgcaatgccttccttgttctcttttggatcactcattctgtaggaagccagctgacatgtcatgaggaccatatgacaaggaacagagggaggcctcctgccaatacccaagtgagtttgaaagccctagtcaagcctttcacatgatatggccccagtcaacatcttaactgcaacctcatgaaagaagctgagacagcaccactcagttaagtgaccccaaattcctgaccctcggaaaccatgagataacaaatagtggtggttttagttgataagtttgcagtaatatattatacagcaataggtaactaatacagattttagtacctggaagggaggtgctggtgtaatacctaaaatgtaggagtggctttgaaactgggcagtgggcagaagctaaaaaatcttcaaggagattgtcagtgcaagccttagtagaaaactggactctgagaaggctctggtgtagcttaaaatgaagtgaggaacatgttattagaaaattgagcaaggggttacgtagttacgtagtggcagaaagtttagtgactatcacctagtcaggtgaaagtagaaaatgtacctgagtcatctaattgagatttccagccagaatgctgaaagtgctgattggtttcttcttgctacttatagtaaaatctgaggggacagaaacaagctaagggaagaagtgttaaacaaaaaagagccaagagccaatacctgctggttttgaaaattcccagtctttccagatggcaaaagatgctaaaattaactgctcccaagcaaaggttatatccagggcactaaagaaaggtgcagaaatatgaaagatgagggtaaaaatcctttttactttttctttgagacagagtttcacccaggctggagtgtaacggcttgatctcagctcacggcaacctctgcctcccaggttcaagtgattctcctgcctcggcctcccgagtagctggagttacaggtgcaggccaccatgcccagcaaatttttttttttttttttttttttttttagtagagacggggtttcaccatgttggccaggctggtcttgaactcctgacctcaggtgatccaccagccttggattacaagtgtgagccactgcacccagtcagagggtaaaatcctttaaggctctgaaagatcaaaaatgatgcttcagagtacagtagtcccctttatctgtggttttactttccatggtttcagttacccacagtcaattgtggtccaaaaatattaaacggaaaattccagaaataaacaattcataggttttagtttatttatttatttatttaatgacagggtcttgctctgtccttcaggctggagtgcagtggcgtgatctcggttcactgcaacctctgctcctcggcctcaagcaatcctcctacctcagtgtattgagtagctgggattacaagtgcccaccaccacacccaactaacttttgtatttaagtagagatggggtttcactatgttggccaggctgttctcaaactcctgacctcaaatgatctatctgcctcagcctcccaaagtgctgggattagaggcgtgagccaccacactcagccaacaattcttaggttttaaattgcatgccattctggttagtgtgatgaaatctagtgcagtggctctgagttccattcaggacataaatcatcccattgaccagcatctctatgctgtgtatgctatgctcttgtggtgttataatatacattggttttgtccacagttcataactcccacagcccttgttacagtcttttgttataatgttcggtgttaggcctcagaggtaggcttctgaccttctgccatccttttacctgccccaaggcaggactctaatctttctgattgtgggttctaagaccctcccaagagagaatcctgccctatactctagcgggagagaatgcttaagtcatgaagcttccataaaaacccaagaagactgggttcagggagcttccagttagctgaacaacacttggaggttcttggaggttggcgcactcagggaagccatggaagctccatacctctttccacacaccttgccctgtgtgtctcttcatctgtatcttttgtaatatcctttataataaacctgtaaacgtgtttcctcaagttctgtgagctattgtggcaaattaatgaaatccaaagagggggttgtgagaaccccaacttgaagtcagtcagtcagaagttcagtatacccagacttgggagtggtgtctgggggtatggggggaagtctggaggaccgagaccctaacctgtaggatctgacactaaactgttccaggattcctgacactcagagactatgtgagttaatgtttaagctgttagttttgtggtaacctgttatgcagcaacagataacacattcccttccctgtttgcaaagcacacaatcccacccatcaaaaaacatggaaaaatggtactaaggtttcgatgtgtatgtttatacacacccatgcacacatccctcagacagcttttctgtcatttctgacattgtgcctctttctactgttttggattctatcaatccctggataggatcaaggaataaccccatcccattcacatccaaagttctaagccattagcccacatacatgaatacaggggaagatacaaatgagtctaagttataactagagcaggggtcagcaaacttttttctataaagtgtcaggtagtaaatattttaggctttgctgggtgtatatgggtctctggctctaacaatgttttgaaaatttaaacttagcctaaaagccacagtttgccaatgcttgccctaaagctaagaaagacttgtgtcttagtggcagtcttgccacacattgataattgttctaatttcaatctcataaccgggaaggaaagagtctaaaagggctaaccactgaaatggaatttactttatttatatgatgaatgcttttaaaagacaaaataactcacttatataacatttgtctgtttttttgagagagtctcgctccattgcccaggttggagcgcagcagggtgatctcggctaagcctccaccttccacctcctgggttcaagcgattctcctgcctcagcctcccgagtagctgggattacaggcacacaccaccatgcccagccagtttttctatttttagtagagacggggtttcaccatgttggccaggctggtctggaactcctggcctcaagtgatccgcctgctttggcctcccaaagtgttgagattacagttgtgagccaccataccagcatttgaaagaataaaaatcactatgggattaagtaaactcaattgtatttagaatttatcattcttttccatagatgttatcatgaataattacaattgcaaagtacatataactttgtatgttcctttcttattttgcattatagccaaataaaattgtgtactgcaatagctcctataatcactacttttgataactgaatactgtttgtagtaggtatatatttaataatttgactttcagtttggtttccaagttttgggttttttgtttgtttttgaggcagcatctcttgtcacctagtggtacaatcataactcactgcagacctcctggactcaagccctcccgccccatcctctcaagtagctggtcagactacaggtgtgcaccaccacgtcttaattttttttttttgagacgcagtttcactcgtttcccagactggatggagtgcaatggtgcaatctcagctcactgcaacctccacctcccaggttcaagtgattctcctgcctcagcctccccagtagctgggattacaggtgcccgccactacgcctggctaatttttgtatttttagtagagacgggttttcaccatcttggccaggctcgaactcttgaccacatatgatccacccacctctgcctcccaaagtgctgggattacaaacatgagccaccacgcccagctggtttgaatcctttgttaaagaaaattaaaaaataggttaggcatagtggcacacacttgcaatcccaacactttgggaggccagggcaggaggactgtttaagcccaggagttcgagaccagcctgggcaacatagcagaaccctgtctctaccaaaaaaaaaaaaaaaaaaaaaaaaaaaacctcacaaaaaacaatgctaaagaaagcgaatgagatataatgaataaaaacaaaaatagagaaaacaaaactaaagcaaatggggggttgcttcttggaaaaagtaaatcagaaacattgataaaaccaggacgaattaatgacaggaagaggaaatacactttaatattagaaatgagaaaggaagtgggattccgagtagttaaaaccatatcctatcccaaacagaactacttttgcttcaggaaaggaaggtttctaacaagaaagctgtaagtgcaaccaagtaaaaacttgggttagtaaagaaaatgattgtcttaatagatgttgtaaattataaaactaaataattctctttaaagattctaaaaaatagaaatagaaactttttttttttgagatagagcttcgcttgtttcccaggctggatgcaacctccgcctcccaggtacaagcgattcttctgtctcagcctcccaagtagctcggataacaggcatgcgccaccatgcctggctaacttttttgtatttagtagagagggggtttcaccgtgttaggctggtcacaaactcctgacctcaggtgatccacccgctttggcctcccaaagtgcagagattacaagcatgcgccaccacacctggccccaaaaatggaaatagaaattatttaagcaatatacttattacctttaagggcaaatcatttcttattaaagccaagaacaaagaagcccattaactccatcttaaatattgtttagaagttctggctgtagtgccgggcacggtggctcacgcctgtaatcccagcactttgggaggccgaggcaggtggatcatgaggtcaggagatcgagaccatcctggctaacatggtgaaaccccgtctcttctaaaaaaatataaaaaattagccgggcgtggtggcgggcgcctgtagtcccggctacttgggaggctgaggcaggagaatggcgtgaacccgggaggcagagtttgcagtgagccgagatcaggggccactgcactccagcctagctgacagagcgagactctgtctcaaaaaaaaaaaaagttctggtggtagcaataaggctaaaaatgaacacaagtggcaaaaaggcaaagattatacagtggtactaaataaaaattaaaaactaaaaataggccaggcatggtggctcactcctgtaatcccggcactttgggagaccaacgtgggcggatcacttgaggctaggagttcaagaccagcctggccaacacgatgaaacctcgtctctacgaaaagtacaaaaattagctgggcatggtggcacacgcccatagtaccagctgctaggaagaatcacttgaactcagggggtggacattgcagtgacctgggatcgcgccactatactccagcctgggtcacagagcgagactctgtctcaaaaaacaaaacaaacgtcccattttacttatggtggaaagacaatacagcaacaatacagcaacagcatttttttcacaaaacattttattactataattgatattttacttataatttttggcaacattaataaaataataaatttcacctgaaagaacaagcgagcaaaatagacaaggaaattcacaaagggcaataacaaaatagtaatcttgacatattcaatatatttgtaaacaaaacaaagtgacattgccttaaaaatatatagaggtatcaatagaaaaacagagaaagctcctgaaagaactcactatattaattttcatttggttgcaggcacagaaattgactcaagctagctcaattctaagacagaagcaaagcccttgatgctgatcgctttccagctttttcatgaaaacctaggaaatttaaatactttgaagaggaagaaaagagtggggagagagtaaagtgcctttaagaggaaaagtagaagtttttttttttttttaaagggagatctcattgtcagtggcattttaagagccttgaagctcaatgaaccaaaggaagtgtcaaacaattaagtgaggtagcaagccatgcaggcctaggggaagggcattctaagaaagacaacagcatgtgcaaagtctttggattgggaagaatgtgatttgcttaaggaatagcaaggccagtgtgtcaaaatagtgcgtcattggggaaaacagtggagaagcatgacagagaatgaaaaagagaggaaggaggtaggcaggggccagatcactggaatctacagttggcaattaatgaccatatgtactccttaagagcatgctttaatgaaactgcaaacaacagtgttgataataccaaccaatcactcaacatacaactaaaacacttcatatttttaccacagaaacagaatacgggaggtaagtatgaaaagtctgtagatctatttatacacagtgggagtatctacctgagacaagaaaaactggcacacacacacccacttgcacacacataccctttcttcaactaaagaaaggattcaggctgtaattttagcaaagtgtcttaacccaagcaacgtaactgaaaagacctagtatagtgttcaaggtgcaaatcaatcaaatgagtgtccggcaaataaatacaacagaatctatggatctagagtcagaaaattttctaaaatgtagataatatactcacaacttctttgttatctgtactgccttctactctaagagggatgctaagctcttaattatctcttcccggatttttgtgaaagcttaggaaatttaactagattgaggagggaagaaaggagtggggagagataaggtacctttaaaaagaaatcaaggaaaaagggagagatttctccagacctatgtctacagccaagatggcggattccttgactggtgaagacaggctgctgggcaccttggtcaggggtggaggaacaaaggatggcaccagaacacaagcagggagacaactccgggagtccacagaggcagccaagactgctgatgttcaggaaccaatactcaaaaggtactccagaatactgtgaaacagcccctggggagagcaagggaaaaagattcacccatagtacagattagataggatagatcagatgaaggacattaactctaagtcttaaaacttattgaattagagagacatttcttgcacactggtgtgtgtcaggtaagacccaaacagcattagtgtcaaaaaactgggaaactatacatttaacagaatagctgcaagctgtaatacattcatgtccaaagcaagacataaagttgcaagcttcacatgttcaattagggtaagatatatatgcacagaaaaatataaagccattatgggtttaaattcagtcagtcaccctgggctatttttgtccactgtacctactgttgttgggacagtcctcattccagcttaacagtgggaaaactaaatttagcccagtccaggaactggacagacaccacttgtttggcccttttcagttaaaactatgggtccagtacagttcaaattatagatattagggcttcttccccttgggaaacttgctttacagctgtggctgagaatatggccagttcattctccactaacggctagccagaagggagaggagagggaatgaatcaaattcacctttagatcacagaacaggaagtcagctagtaccaggcaccattctattaattttattgctatttcacctcaaaccaatgatacatgacggctgtttgatgtctgcaggggcccttcaccaaacaaaaccattttactttgaatggtttggcttccttggatgttttcaggtaggtaaagatactctgaagcagtgttccttttgacctggccccaagactagaatgaatgtgtgcctatccttcaactagaacaaagaaccactgctctccctcaactaacctccgccttcttggtctctgctcacgcagcagcttctctttcaattccacatcctggcttttcagaatcttttcaggttattttatgccagcacagcagaggcacttctgggaattcggcagcaagtgggccagggcataacaaagccattccagtctgactagagttaaccatgaaatgctgaatgcatggaaaaagctgtaaagaaaactaagtatttcaaaaattctatgaattctgtatatagaaaaaagagctttcaagcttaggagtaacatgaaataccaaaacaataaataggtgccaggggcagtgactcacacaacccagcacttggggaggctgaggcaggaggctcccctaaggtcaggagttcgagaccaccctgggcgacataacaagattccatcgctacaaaaaattaaaataaaaaactagctgggtgtggtggctgcgcctgtagtcctagctactctccaaaggctgaggcggaggaatgcttgagcctggaagttcaaggttgcagtgagctaggatcacgccactgcactccagcctgggtaacagtgagaccctgtctctaaagtaaaaaaaaaaaaaattaaaattaaaaaaataaattaatacctttctctctcacacacacacacacaaacaccttttatgtgttaagccagatacagttaacatgaaaaccagatgttttaaaataatacctcaaaattcagatcaaataatatatatcctgaatcttgtttaaaaagtcatatataatccactagtttcactatttttggtgctactgaataatgtatggtttgtattttttgttttatgaggttttttaatttggtttgaaatacttgctttagatttactgaaactagaattaatgggacttttttgaaattttgcttttagacctggggagtgatggttcagagtcagatgtgctcacagttatggatgctacatccactgatcctggctgaagaggttccagtgacacttgaatagtaacttttgtttcaggaggtaatccttctagttgcttaggcttcttaaacatttgatgacactgggtcttgtgctccattttctccttgaaagttaaaaactgtagccggcacttggaacactggtgtgcactctttccccagtggcccctataatgacacatgtatggtgttgctgttttgaaaattttgagacaaaagggacaaagcaaattctttgtgttttcatggcacgttctaaaatgtgtttctacatcagcaaagaccgacgatctataatggcaaacctggcacacatagggcatttcgccaggcttatgatggtccttcatgtgttgtaagaggacctgatctgtttcaaatgacaattcacagattttacagacagtagagggctcctgggcagtgtggacattttcgatgtgacactgtagctggaagggagtgggaaactgccggtggcagtgctggcaggtggtgtggttttcccagctgtcgttcctctgcttctcaaattccaaatgatgcttcacgtgattcataaacttaacattttttagaactttcacgcagctgaggcatttaaaggtggtgtgagtcttctgttccggctgcccttctcctttatgctgtccatagtaaaagtcactaagtaacacaatgggattttctttcttgggatcaaaggtcttgttttgacttgttagactcaaaatgtctgtttttgccaattcattttccctatcaagatttgtatttataggcttgaaatggatattgtcctttggaaaagctgctggaaaaggtgctccattctgaacatggcttaatgaggtatgaacattatttgagggtgtactttgctgagtattcattgtatgaaaggtatctgaagggaacgaagctgaagaatttccttctataattccatccctgagtttagcccttttgggatttatgctgtttacttcgaaagtggaaagttgctttgatacacgaggactttcatttatacctcctactgaaagtgctgtacttactggatgatgcaatgaatctgtgaatgtaatcaaaggagaaggtaattctgaagagttattaggcacaacttgtggtgaactatttctataatcaggtttagacaaaggctcaataataataggactatctgttgatctcgattcaagttgggaagctggcaggacggtcactgcttctgatgtaacggtctcatgacttttaggctgcaatttgcgagcagtatcttttctaaggtgatcatacttttttctccttgaccatgaacccggggtgactctgttcaaaatgtttgaaacgactggttttgaatttgaagtcaccccaacaaagattagctcagcatcttcatttacatgttccacaccaacaaagatgagctcagcatcttcgtcatctacttgtttggtttcttgtatgttcttctgtggttcaggctctttctcttcctcacatgattgttccattttctaatttttttattcctgaatggtggggccacaagtcccaatgcttcctttatataaactgccacctaagtacaaacatacatcagtaagtacaggaaaatgcattaccttatttaattttcctccaaaacattgtttttataaaccactattttacccacaaggacactgagactgaaagaggataaataacagcttaaaacctgtgataaaagatcaggttcctatgaatctagaatcataactttgctgtactgattgtgctctattccattttaaaaaaaaaacctaccagcagctaatcactaggcaaaattatatggaaaagacacacatttttatgagggcatcattgtgcagtgtttagaaacatgggctttggagttgaagagtaagctggaatccttagtctgccacacaccagatgcttcctctttagcaagttttttacttttaaatgtattttgctatcttaaaggcaaaaattcttatttcttagacttacagtaatagctggttttttaaaagcaccacctattcaatggcagcttgatttgtagtggaattggaagaaaattacaataaatgaaaatatctcaattgattcatatatagtaatctcataaacattaatatagaaaagaggtattaaatttatagagttagagtacctacacataaccaacaaacagcatagcacaatgtcaattgccaggcagataatctcatcccaactcatggccttaattataatccattcagtaatgcctcctaaattttcccctccagttctgacttacccactgaacttaaacacaacagtgcttcctcctcaatctcttctccacatagcaagcagattgattgtgttaaacaaagtcagactgtatcattgttcagctcaaaaccctccaacggctttctgattaactgagagtaaaagaccaagtattaccaatgcctagaagactacactaccaaccccacatactgctcctgcagttatctcatactactctccactatccacttcactgtagtcacactaacctccttgctatttattttaattttttaaattaaattttatttttttgagatggagtcccgctctatcacccaggtatatatttcagctcactgcaacctccaccttccaggttcaagtgattcttgtgcctcagcctcctgagaagctgggactacaggcatgcaccaccacacccagctaatttttgtattttcagtagagatcgggtttcaccatgttgaccaggctggtcttgaattccttatctcaggtgatccacgtgccttggcctcccaaagtgctaggattacaggggtgaggaactgcacctggccctccctgctatttcttgaacatactaagctcttttccttgctcaaagcccttgttccttccaatatgaatgatcatttgggtatccgcatggctagctcctcactgcccttagggctctattccaagtatccctctcggtgaggttcttaaatattccaaccaacctctaacccacattcctaatctcttttcccttttctttcatccccaaagccctatcaccatttaacatattacgatcctatttatcttgattattttctattgtccatccagtggaacataaaactcaaaagggcaggtattctatcttttgttgactgttgtatgcccagcacaaagaacagtgtctggcacaggacaggtgctcaacaaatacagaatttgttaaatgaatcaataaatatcgactctccttcataagatcctttatttttaaagaagattatgctccattaattccacattttctatgaatttactctgagaactttatccattggaaattccgtaggccaataaaggacttaaagctagctttttacaaatatttgaccacaaccaatagtttaaaaaaaaaaaagtgatatggagtccaattacacaagcacatacacataaataataactacctttactacacaggctgcattctaaaattttctatttcatttttcttgtctttttcttttttttttttttttgagacggagtctagctctgtcgcccaggctggaatacagtggcgcaatctcagctcacggcaacctctgcctcccgggttcaagcaagtctcctgactcagcctccagggtagctgggattacaggcacatgccaccacacccagctaatttttgtattttttagtagagacggagtttcactgtgttggccaggctggtcttgaactcctgaccttgtgattcaccagcctcggcctcccaaagtgctgggattacaagcatgagccatggattacaagcctgagctgtgcccagcctcatttttcttaaactaaccacagacccacaaaatcagttaagcctcatcactaggtcactactagttgtttcaaaaactggtctaatgctagcaaaatgtacgcactagaaaccaaggttcataactcaccaatttctaaaaacatatcaagattcactgtatccccatgtggacccttcaaatcagcataatccaaagcataaaaattaaattgacatctaataaatgccatgcacatttgttttaattttaattaggatatcagtatctaattttggaacatatagacaatatttattcctataaatatgtgtatcaccttggaagtgaatttaaaaaggaatacaatattaagtaagcattgtcaactatatacaaactggtgtatcatgaatagtgatttacaacttaattagtagatatataatgccagaaaaaatataaggcagatatgaatacactgctctctggagtcaactaaaattggtttagtctgtctatatacaacttcaatcgcctaactccaggatgatgtcacctagcccagtgtttcctaagcattactgacatttgggactagataattctttgctgggggctgtcgagagcactgtaggatgtttagcagcatctgtgatctctacccactagaaaccagcagtagtcccccagggtggcaactaaaaatggctccaggaattaccaaatgtcctgtgggaaaactcctgcccaaatccaatcttctcaggatcacttccacatttccagtaactaccttctacataattctaaatgtattttctaacatcctctctaaagaaaatatctggccgggcacggtggctcatgcctgtaatctcagcactttgggaggccaaggcagttggatcacaaggttaggaattggagaccagcctggccaacatagtgaaaccctgtctctactaaaaatacaaaaaattagctgggcctggtggtggacacctgtaatcccagctacttgggaggctgaggcaggagaatcgcttgaatccaggaggcggaggttgcagtaagccaagaccacgtcactgcactccagcccgggtgacagtgcgagactgcatctcaaaaaaaaaaaagaaaatattctaattcacaatcattaatattctccaatatcctaaaaaatcagactataatctgacaacatggccattagatttatctgaagattaattagtttattattgttattattttttctttttcaagacggagtcttgctttgtcacccaggctgaagtgcagtggcatgatctcggctcactgcaacctctgcttcccaggttcaagttattctcctgcctcagcctcccgtgtagctgggattacaggtgcgccaccacgcccagctaatttttgtatttttagtagagacggggtttcaccatgatggccaggatggtcttcatctcctgacctcatggtctgcctgccttggcctcccaaagtgctgggattacaggcgtaagccaccatgcccggccaatctgaagattaatttttaaagcccccagaagtttatgatttactaaagttatatggagggtttgtagacagagttagcactaagatgcctaattcctgaattctggttttgtgctctttctgctaaaactgacttagtgcacacttatttctgatgatattgctgttaactgcttagtctttaagaattaaagtgtctcattggattcattttttcactctctattttgtaaacctgttcaaacctcctctacctcccagaaaatgtcaaagtaccttataagccattttaaataacttttagagcatcactcattctacctctcatgtccattcctattaatggcccccagcccaggccgcaacttctaggtttaggtccactggttacttcatttttgtacacttgtactagaccctaaattgttctgtctcttttctctgtccttcaaattatataacacaacaccacaagatggatcttaaaacacaactgtaattatatcactcttctatccctaagcgttaaatgattcctccaattctagagaatattttaggtatacataatttgtgttatgctatgggctgaactgtgttccccccacccccaaatttgtatactgaagctataacccccaatgtgatggtatatagagatggtggctttgggtaataatcaggttaagatgtattcatgaggatagggccctcatgatgtgattggcgcccttataagaggagatatcacagaccttgcttcctctttctgtcatgtgagaacacagcaagaaggctgtcatccaccagccaggaagagagccttcactaaggaaccaaatcgtccagcatcttgatcttgaacttcccagcctaaaaatgtgagaaatgaattcctgttattaataaaccatcaaacaagtaaagaagaaaaacttaaactgggttctaatgacactgctggacttcctaaccagttgctcttggttagatttttggctgttgtccatactgattaaccctccatccaaccatcaatcaaggtgaaaaagaggaatagagcaaggatcaggaacaaagctaataagttaatgaacaagttcattaagaacaagagtagcattagaccatgagagttttcttctcctctagatgtccagagacccttctctacaaatgtccaccaatggatgaatgaatgcttattttccaatttgccagaatcttgagatactggggtagggaggttagacatgcaaagatatatcagatctaacaggtttgtcctcaaaaatcaattctcacctcccatgatgggagaagccaataggagggcttcaattccaaagaaagctgagagatcagtggatgataacccaccttccagattatttctatgcattcaaacaatggcccttctactagatcattgttttttgttttttttgagatggagtcttgctctgtcacccaggctggaatgcagtggcgcaatctcggcccactgcaatctctgcctcccgggttcaagcagttttcctgcctgaggagctgggattacaggtgcgtgccaccacgcctggctaatttttgtatttttagtagagatggggtttcaccatgttggccaggctggtctcaaactcctgaccttgtgatctgcctgcgtcggcctcccaaagtgctgggattacaggcgtgagccaccgtgcccagcctctagtaaaccattgttattaccacacacgagtttttaaccacacacatactcttctgaggaaaggcttccccaaactattggtccttatgatgagatctggccatatatatttttcttctgaaccccaggattgtggggctgtcacatttcctctaacagtacaccttaggagctcccagacttgaagaaaattggctgtttcccacatttgaacattttccactttttccctcagtctacctttttgaattgatttctgactacttctagataacctttttccattaatgaatattgagtgcttattgtgtgccaggcactgctttaggcacttgagagaaatcggtaaacattaacagacagaaatgaacaacaaaaacaaactatttcaacagaaggaactaacaaacagtccagtggaggaagaaagatagtaagtataataaaaatgcaaattctctggtgaactggaagatgacgttatagaattaggaaaaaaataatagagcaggcttagaagttgaggaggtataagagaattgtaattttacgtagtgtagtcagagtaagtctcatggagaaggtaaatttggacatacacttgaaggggataaaaggtcagagaggtagcaagagtggaaatagtagtaaggatctgtaaattcttcatttttctctcagtttagtctgtggcaactgtcatgtcttttgataaggaacgaccttggtttaatagttactcccctcctagactctcaggctagattttttttttttttaattgagacggagtcttgctcttgttgcccaggctggagtgcagtggcacagtcttgtgcacagtcttggctcactgcaaactctgcctcccaggttcaattgattctcttgcctcagcctaccaagtagctgggattacaggcgcccaccaccatgcctggcgaatttttgtatttttagtagagatggagtttcaccatgttggccaggctggtctcgaacccctgacctcaggttatccacccacctcggcctcccaaaatgctgagattacaggcgtgagccactgcgcctggccttttttttttttttttttttaagatggagtctcgctgtgtcacccaggatggagtgcagtggcacaatctcaactcactgcaacttctcctgagatgcttgtgcctcagcctcctgagcagctgggactataggtgtgcgccaccatgcctggttaattttttgtatttttattagagatggggtttccccatgttgtccacactggtctcgaactcctgacctcaagtgatccacccaccttggcctccaaaagtgccgggattacaggcgtgagccactgcacctggcctctcaggctagtttcaaccctattttacactcctctaccatcctcagcttacttttgaaaaagtatttattaaaaaatatttatgaaaaagttatttttgttttatttagttgccctgggatggaatacaaatgtttgctgtagttttaaggatcctataaaactcccatttactgcaaggatctctgtttaatgggcattcaattctaagatagcaaacgtgtagagttatttgtgggggtgggggacaagtttgagaaagaagcagtggggtgaagaaagtgataggcaagggaagatggtggggataggtaccataggagtcctggtggcctaaaatctaatcacagaagttactcaagtgggactgatgcctgaaaaaaatttgtgtgtggctataacagtgagtgggatctactcttttttttttttttttgagatgggagtctcgctctgtcacccaggctggagtgcagtgccgtgatctcggctcactgcaacctccacctcctgggttcaagcaattctcctgtcttggcctcccaagtagctgggactacaggcacatgctaccacgcccatctaatttttgtatttttagtagcgacggggtttgatcatattggtcatgctgctctcaaactcctaacctcaggtgatagacccgccttaggctcccaaagtactggaattacaggcgtgaggcaccgtgcccagcctgggatctactcttaagcaacagagaaaatcagtcatttttccccttttccttcccttcctcctatgagcagaatcttggtctccatctttaaaaaaaaaaaaaaaaaaaaaaaaaggccaggcacagtggctcacacctgtaatcccagcactttgggaggccgaggtaggcagataacctgaggtcaggagttcgagaccagcctgaccaacatggtgaaactccatctctactaaaaacacaaaaatttgccgggagtggtggtgggcgcctgtaatcccagctacttggtaggctgaggcaagagaatcaattgaacccgggaggcggaggttacaaaggagatttgacagggtggcagttcaaactaaaagtggtctgatagttcagagtcaagtttcttcactaaagctgagtttttaaagggcttgaagaatgatgtaaagaggggttgtggaggaccacaaaaaaagacaactaaaaaaaggcataacaaagtcaacttattaaatgcccagcaacagggtgaagttaaggggaatggtggaataaagacctacaaatagctgctgcttcataaaagcaaagagaacactagcaaaaactacaaaaatcacgtttttcagatcctggaaattaacgaaagcttgtaaaactcaaaagattttattacaaaatggcttggcggttcctcaaaatgttaaacatagacttatgatcccacaaatctaagtatacactcaaagaaataaaggtactcaagtacatgtatacatgtttatagcaacaactcataataatcaaaaggtggaaacaacctaaatgtccatcaatggatgaatggataaacaaaccatggtatatacatacaacagaatgtttattcagccataaaagaaacgacatactgatacatgctacaacagggtaaaccctgaaaatataccatgtaaaagaagtcagtgacaaaagctcatatattgtatgatttcatttacaggaaatatcagaaatagataaatccatagatattaaacaaagatttgtggttgccagaagataggaaagggaaaatggtgagaaactgcttaatgggtaaaggggttttactttggaatgatggaaatgtatcagaactagatagaggcagcacacgtacaatattacaaatgcactaaatatcactaaactgtttattttaaaatgactgatgttatgtgactttcacctcaatgaattattttttaaaaataaagagggtatattactaccaaccacacagaaaaaaagagaattataaaggaatactatgaaaaattatctgtcaacaaattagataacctagatgaaacaaattcctagaaagacaggaactaatgaactgactcaagaacaaacagaaaatatgaatggatccaaaacaagcaatagaattagtaatcaaaaaacttccccaaataaaagcccaaaatcagatagctatgctagtaaattcttaacgtttttaaaagaattaacaccaatccttcattaactcttccaaaaattagaagaggagagaaaactttgcacatctttctatgaggctagttattactcttacaccaaaatcaaaccaagaaatcatatataaaaaaagaaaactacaggccaatatcctttttttttttttttttttttttttttttggagacggggtctcgctctgtcgcccaggctggagtgcagtggcgtgatctcggctcactacaagctccgcctcccaggttcaggccattctcctgcctcagcctcccgagtagctgggactacaggagcccgccatcacgcccagctaatttttttgtattttttagtggagacggggtttcactgttttagccaggatggtctcaatctcctgacctcgtgatctgctcgccttggcctcccaaagtgctgggattacaggcgtgagccactgtgcccagccaatatcccttacagaggcaaaaatcctcaacaaaatgttagcaaacaaaatctaacaacatatataacgattacataccatgaccaagtgggatttatttaaaaaatacaaggatggttcattctatgaaaatcaaccaacaataattttatttttattatttttaattttaattttttttttgagtcggaatttcattcttgttgcccaggctggagtgaaatggcacgatcttggctgaccacaacctccgcctcccgggttcaagcaattctcctgcctctgcctcccaagtaggtgggattacaggcatgcgtcaccacgcccagctaatttgtttgtatttttagtagagacatggtttctccatgctggtcaggctggtctcgaactcccgacctcaggtgatccgcctgccttggcctcccaaagtgctgggattacaggcgtgagccaccatgcccagcctataccattttaataaaggacaaaaactacacctgcctgcagaaaaaacacttgacaaaagctaacatccttttatgatttgaaacaacaaaacgattaggaatagaaggaaactttctccaccagacaaaggcatctgtatgagactcacagctattatagtatcatacttaatggtgacactgaaagtacccctgcccctaagatcaggaacaagacagatatccactttaaccacttcaactcaacaccgtactagaggttctatagccaaggtaattaggcaagaaaaggaagcaaaaagcattcagattggaaagcaagaagtaaaaccataatggagatgacaaatacaaataactcaattttttaaaaggccaaagaacttgaatagacatttctccaaagatgatacacaaaagaccaagtaaatatattcagtgtcattaatcataaaagcaatgcacattaaaaccaccttgagataccacctcacacctagtaggatgactactattaaaaaacaaacattgttggaaagaaattagaatcctcatgcacagtcactggattgtaaaatggtataactactatggaaaacagtacagaaatgcctcataaaattaaaaacagaactactatatgttctagcaatcttacttctgggtatatatctaaaataattgaaagcagggtctcgaagagatactggcacacccatgttcacagaaggactattaaaatagccaaggggtagaagcaacccaaatgtctacccaaaaatgaataaacaaaatattatatatatatatgcacacacacacaatagaatattattcaacctcaaaaaggaagaaaatctgtcacatgctacatgtttgaaccttgaggatattatgccaaataaaataaaccagtcacaaaaagacaaatacttttgtatttgtataattccacctatatgaggtaactaaaatagtcaaattcatagaaacagaaagtagaggccggaagcagtggctcacacctgtaatcccaggactttgggaggctgaggtgggcagatcatctgaggtcaggagttcgagatcagcttggccaacatggcaaaaccctgtctctactaaaaaaaatacaaaaattagccagatgtggtggcaggcacctataaacccagctacttgggaggctgaggcaggagaattgcttgaacccaggaggcggaggttgcagtgagctaagatcacgccactgcactccagcctaggcgacaagagagaaactctgtttcaaaaaaaattagctgggcgtagtggtggcacacacctgtagtcccagctactcgggaagctgaggcagaagaatcccctgaatctgggaggcagaagttgcagtgagtggagatcgcaccactgcactccagcctgggcaacacaccaagactccgtctcaaaaaaaaaaaaaacaaaaaacaaaaaacaaaaaaccaaaaaaacaaaaaacagaaggtagagtaatggttaccaagggctaggggcagaggaaaagggtgagtctgttgtttaatgggcattgtttcagttctgcaagatgaaaaagttctagagatctgtttcacatcaatgcttgaaactactgaactattaatttagaaatggttaaggtggtaaattatatgcgtttttaccacaataaaacaattcattttaaaaacaggccccaatcggcatggtggctcacgtctataatcccagcactctgggaggccaaggtgggagaatcacttacagtcaggagtttgagaccagcctggccaacatagcaaaaccctgtctctactaaaaatacaaaaattagccggcatggtggcacgcgcctgtaatcgcagctactcgagaggctgaggcaggaagaatcacttgaatccaggaggcagaggttacagtgagccgagatcatgccaccacactccagcctgggcgacagagtgagactctgttaaaaaaataaaataaaataaaaaataaaaaataagctagacacagtggctcacgcctgtaatcccaacactttggaaggctgagatgggaggatcgcttgagcccaagagttgaagatcagtccaagcaatgtagtgagaccccttctctacaaaaaatttaaaaacacaggcacagtggctcatacctgtaatcccagtattttgggaggctgaggcaggaggacttagtcagctcaggaattccagaccagcttgtacaacatagtgagaccctacctctacaaaaaattaaaaaattaaccgggcgtggtagagtgtgcccgtgatcacatcactgcactacaaccttggtgccagagcaagactgtctcaagaaaaaaaaaaaatttaaatttagctgggcatcatggcacacgcctgtagtcccagctactcaggggtggaatgaggcagggtggcagctgagatgggaggatcactggagcctgggaggtcgatgttgcagtgggccataattgtgtcactgtactgcagcctgggcaacagagcgagaccctgtctcaaaaacaaacaataaaaaatgggcgaaggatttgaacacttctccaaagatacacaaatggccaagcagcacatgaaatgctgctcaatatagtcattaaggaaatgcaaatcaaaatcacaatgagctattacttcacatccactaggttagttataagcaaaaacaatctcaagcgttgcagaggatgtgcagctatctgaaccctcaaatactgctggtgataatataaacttgtactttggaaaagtttggcaattgctcaaaatttaaatatggcgttaccatatgacccaacaatatcactcctaggtatatacccaagagaattgaaaatataacacatatataagctagctggaatatagccataatgctgctacaaagtgcaaacaaccgaatgtaaattaattgataaatgaataaacgaactgtggtatatccgtacaatgaaatactattcagccataaaaaaactaagtacaaacaagcatacaatacggtgtaccttgaaaatacactaagtgaataacaccagacacaaaaggccgcatattttattattttacttatacaaaatgtccagaataaggcaaattcatacagacagaaataaagtagcagctgccatgggctcgatgaagaagaatgaaaggaatatagcaggtttgaaaaatggcccccaaaatatcaggtcctaatcccttaagcctgtaaatgataccttatttggaaaaaggatctttgcagatgggaaaattatcctggactatacaggtgggccctaaatgccaccacaaatgtccttgtaagagaagcagagggagatttcacacatactctaggaaaaggtgatgtgaagacagaagcaaagattagagtgacatggtcacaagccaaagaacgtcacatccacaaactagaagatgcaaagaatggattctccgctagagtttcccaggggaggacagccctgccaacatcttgatttaggtcttgtgaaacttattttagacttctgacctcccgaactaagggagaataaatttttgttgttttatgccaccaagtttgtgataatttgttatagcagctatggaaaagtaatatagggagtgactgctaatggatacaaggtttctttagagttgatgaaatgtcttggaattagatattgctgatggttgtacaattttgtaagtatataatactaaaaaccattcaatttcacaccgcaaagggtgaattttatggcatatgaactatatttcaaagaaaaacaaatgcctagtaacaggctggtataacccgccatctcccaacaactgctgctaaattttcaaagcaccattaagcagactcaattcgtagcaaggataatggaacaatgcaagctcatctagcgaacaaaaagaattaagctagtatcaggtggtcaatttacaaactgtagtgggagtcatacattcccaaggatggaacagttatatctccttgcagagtgaactcttctccgataccaaggacttggaagaccaaataaattatacgtaggattaccaaatatgctggtatgaccaagacagttatagtttaaacttctatctctgtggaattatggatagtgccactcttcaatctttaataagtccttcagtttagatgataaattacatagtcaacctagttataaggaatctagaggttgtgaaaagctgtgagagcatattctatgcagaccacataggtcctatcatgactccctatgtaacttgggtctctgcgactgggaagctcccagggaaaaaaccccagttaagacttctgcagagcattcacattttgtttcaaacttatacaacactaatgctaaagctcaactctcagaattgtattattcagtattatccaaataactgattaatttacacactgaagggaaagaacaaggaatggacctatacacacttgtagtttacaagtataagaagctaacaaagaataagattaaaataacttgtgccaggccgggcatggtggctcacgcctgtaatcccagcactttgggaggctgaggcaggtggctcacgaggccaggagtttcagaccagcctgaacaacatggtgaaaccccatctctactaaaaatacaaaaacttagctgagcgtggtggcacacgcctgtaatcccagctactcaggaggcaggagaattgcttgaacccgggaggcagaggttgcagtgagctgagattgtgccactgcactccggcctggacaacacagcaagactccgtctgaaaaaaaaaaaaaaaaaaaaacaaacaacttgtgcccacattaactaggtgttaaaagccaaaaggtgaaagtcactattctcttttcacatatcaaattgaccctaaggtaatattgctgcattagaactgagctggtgggagggatgttaagaaattagggagaaattgttaatctacagaaagaccatcatataaggttctgtgtgtagccaaacatacacatttgatgttctgatgtttgctattttagtggaactatagctataaaatgtattcaatcagtagaattaaaacatatcccagtccacaaaaaactaagagagaaattatacaggaatgatcaagaatctgcacagttctcataatctcattactagagagaaaaggagaaagggaagcatcaaggtagtatttgagacgaatttaagaagaccactcattcaataaaagtttggtgggccaacaaggtgccatgtattggtctggtgatatagcagtgatccaaagtctttcacttcagggagctgacattccagaaggagtagtcagaaaataatttttttaacaaaagtaacatggttatataaacactagggagaaaaataaagtaggaaatggaggcaggttgatactcacataacatgaatatggctgtctggggaagaatactccaacaaagggaacagcaaacacaaagcctctgagactggagcacttaacacatgcaaggactgatcaataggctaacacaggtggaccaatgaaaagagtgacaagttagaaatgagataaaaaatgagctgtttgtggcaaaggaaagccaagatcatgtaggccattctaaattcttcagctttggccaggtgtggtggctcacatctgtaatcccaacactttgggaggccgaggcgggtggatcacctgaggtcagaagttcgagaccggcctggccaacatggtgaaaccccatctctactaaaaatacaaaacgtagccaagtgtgctggcatgtgcctgtagtcccagctactcgggaggctgaggcaggagaattgcttgaacccagaagacagaggctgcggtgtgctgagatcatgccactgcactccagcctgggtggcagagcaagactccatctcaaaaaaataaataaaaataaaaataaaaataaaataataataatacaaaaattagctgggtgtggtggcgggcacctgtaatcccagctacttgggaggctgaggaggagaatcacttgaacccaggaagcagaggttgcagtgagccgagactgcgccattgcactccagcctgggtgacagagcgaaactccatctcaaaaaataagtacataaatagacaaaaaataaaaacaaattcttcagcttttaccctgagtgtgatgagagattactggaaggctctgagtgagaagtaatatgatctcactcatttcattaggattgctgtggttactgtgtggagaatagactttagagagtaatagtggaagcagaagacaagaagctactgaaatattataaacaaaagatgatggtagtatcagacaggatggagaaatagagatactaagaagtcggactctagataaaaatctagaaggcccaattcattgatggattgggtttgggatgtgaaggagaggaggaggacacacaagaggtaatgctgagcaggtaaatctatgagatcagagcccaaggaaagttccgaggtaggtacttaaattttgaagtcttcagtatgtagcattatttaaaacacaagactggatgagatcactcagggaaaagaggtctgagatctaagctctggggcattccattgattagaggtcatggagatgagaaggagctggtaaaggaaattaaaaaaaaaacaattattcacagccattcaggtgggaggagaattgagaaagagaagcatcccagaatccaatggggaggagaaaaggaactgtaatatatgctgccaatagatcaaataaaatcacgaaaatcaactaaaactgaccaatggattaagcaaagtggaattcattggtgaccttgacagcagtgggtttaaggaagaacgagaacaggagatagcaaatacggacaactctggagaaattttcctgtaaggacaagcaaatacaaattaaaacaagcagatgggagatgtggcatcaaaaacgagatctttaaggtgaggtgatggtacaatcagtatgtttgctatattaatgatctggagagatagaaaacttaaccctagacaaagagaagtcttgctagaataatatccttaaataaacaagtgcacatgtagaggttctggccttagcaagaagtcaaattattcacccagagtaacaggacaatgctttgagatcctatggaaaagggttaaatggtggataaatggttgcggtggccatcctccaagatggccctaaatgaatcccacttcctggaattcacatagttgtagccctctcccactaacagggttggcctgtgggatcaagcacatacagcaggaagtgatggtatgccacttcagaaattaggtcataaagactctgcccttcatcttgggtacaaggtctcttgaatcatttgctctgaagtaagccagctgctgtgacatgaacagccccatggagaggcccacagagcaaggaactgaggcctcttgccaacagcccagtgagtgagcttagaggcagatgatccaaaccaagtcaattccgcagagactgacaatccagccaaaggtttcactgaaacctcatgagtgaccttgagccagaaacagccagctaagccactcttggattccagaccttcaaaaactatgaggtaataaatttttttttaaactactaagttttgagacaatttgttacacggcaatagataactaatacaatgggtctcactgagctgtaatcacaaattgctgggcacacaattcactataatctcacctactggcatgcaatgacttcagatgacctcccctgtcctgctgcatgcagttacctcatgaaatacagtcgctgagaaagagggtaggataaaaggagtcagctttatataacttaacatccctgatgctcttttttttttttcaagagatgtggtaaaagaatgccactaccaccctctcctttctcaacaaagcaatttagagggttcccgaatgacctacatcaacaattggcctgaactaatcaaacgcatcattcagattccctcagtaaaatattgaataccaaacagctatgcttcagcaaaggaaagggcaagggagcgaaactgaaggacgaaaatacaactttggtcctcatcagggagacttctcttttcttacctcaggtttattacaacgcaacttttaagaacttgagctattccaggcagaaggtcacatccttgaggtaaccagagagaagcattagttacttacatgtcacaagaatattttcgatcccactgcctgacattgccatttaggtgtttatcaatcatctcacacttaaccagataagtgaactgaactcctttcccccagatctgttcctccaatctaccctaccttagcaaaggaaaacgtcccacccgccaactgcccaaatcaaaagcctgcaaatcacccgaggtcctggctctcacgggagggactccattagggtcccaggggctgcattaagagtcccgacagcgacgcagtaaatgagacaagacgctgcggtaggggagagagacccatacattcaaatgccttaaggggtctgggcctacaggtctccagaactggggagggcctggggttacaaagcagttttcagatttttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctccggcagcgcacggccaagcgcggtgtcgcgacccgcagggctgcggctcgccatgaaatccctcaagtctcccctcagggaacgctgaagccgcgccacgcccccgtccttaccagtccggatcagctgctgttcgcgagctgccggccacgcaccagccccggaggcgctcccggggcacagccggcggcgactacgcctcctcaggcccccggcgccgccgacgcgcacgcctccacacgcgcgcgtccagtggagacctgcgattggctgccaggtgccggcgcgagatcggcgcggctccgagctaggagcatgcgcgcgctctgacgcccctggtggcgacggctggacgcggggttaaattgagaaggaggagggcagcagcaatacccctgaggccttgaaaggatcttgggttccggatcacggttccaggcagtcagggttccagagctgagggggtatccaagcagtcagggttccagagctgaggagcatccaggcagtcagggttccagagctgaggggcacccaggcagtcagggttccagagctgtcgcagccagggcttggggtggggggtaggcttccagtccatcaggggatggtttgcccaccagaaggccagctgttataattctcaggtgtggtccctttgttgactatccatgcttaagggattgtgaggaaacaactgaacctaacatctgtcctcttctagttacatctggggccagttgaatccagcctgccacctgtttttgtacagctggcagcaagctaagaaccgatttcacgtttttttaatggctaaaaagagaatattttgtggcatgtgaaaattatatgaaattcaaaattcagtgtccataaataaagttttattggaacaacaaacatgcccattcctttcggtattatttatgcctgttttcctgcttcaacagcaaagttgattaattgccagagaccatgtatgaaaagcttaaaatatttactgtctggccctttacagaaagtttgcccactcagtttacttgcagctttgattttttttttgaattgaccaattctgccaaaagtctattttagcaatctttttggggggcgggtaaatcgcttttggtttaattaatctataatgttattttcttatctattttatctatttcttccattctgttattttcttccttcgtgacttcataggcttgttctgttacttctcattacaacttttggagaaaaatgcctacctcgtttgcttgtaaacttttttgtttctcttgtatttaatgctataaatttacctttaagtaccagtttaactgtgtctcaccagtccgcttggtaatatgttcattatccttcaattagatatgtcctaattttgctagttgttagaaatgcttgttccctggtgccgcaaagaaatagcacttgaacataaatttaattttctcagcaaggccattttcactttctgcagaaagggtacactcgccagcagttttgccacgagagtaccccaaacaaaggatacagggttatttataacctgacgcatccaccctactgctgtgtccggtttccattggctggaacaggacctcacattctgtgtttgtcccgattggctaacaacttagaactttctaaaagaggcaaaggcagaggagaacaaaggaaggaggatgtaacttgtagaatgctgagaaaggtaaaaacacctccaaataggaagaggaacaggctatgacctaatgcttgcttggaccagtataagcatgcaagggcaaatatttaggctaaattgtgggagctaagaacacaaagtatattaatttctttattacggctagcagatatctaagaatgttagcacaggtctttgaataaattttacttctaagagaagttactatttattcgtaattagacagggaggaaagtctttgaagaggaacctctactttattttttacatagtgattctttctaacacaagggttatatagtatatgttatttatttttgaaatctatgagatttttaaaagattttttaattgtattataatcaaatcacatggcctaaatattactcacccttgcatttgaagatttctgttcagtgaagtgtaccatagtcaaaatgaagagatcatagatgtaaagaagatatttgcagtatctaaaatgtatatatgaggctgatatgtaaagatatttgcattatctaaaatgtatatatgaggctgatatgtaaagaagatatttgcaatatctaaaatgtacgtaagaggcctggcacggtggctcacacctgtaatcccagcatttttggagaccaaggcaggcagatcacttgaggtcaggagttcaagaccagcctggccaacatggtgaaaccccatttttgtacaaaaaatacaaaaattagctgggtgtggtggcacgcgcctgtagtcctagctactcgggaggctgaggcatgagaactgtttgaacctgggaggcagaggttgcagtgagctgagattgcaccactgtactccagccttgggcaacagagcgagactccgtctcaaaaaataataacatgaaaaataaatctatgagaaatgatcttcttttggcttcataataattccaatgtccatcagtaaattagtatcaactaagctccaggctttattcaaatgtcactagtttttcccatcatcctttttgttccagattcccacccaggatactgaattgtacttggtcattttgtgttcttagccttctgtggtctgtgacagtttcttaaacttttcttgcttttcatgaccttgacaattttaagaagtaaaggtcaggtatttttcagagtgtctctcaatttaggtttgatgtttttctcatggttacactggggttatggtttttagaagactatcacagacatgatgtgtctttctcataatttctcatcagcgatccatgctatcaataagacttcctactggcttctccgctgtaaattacttcccccccctttcataccttattctaaatcttgcctacatgcaggaaggccgtgaggtctcattgaaggaaaattatctacacaagttactttgcaattcttctttaaggaagatttgtctcttcttcctttagttttaaattaatcaaaaatagctttttagttttaaattaatcaaaaataaaataaaaaatttagtacctcagtcatacttgccacatttcaacagatcaatagtcacctgtagcatattggacagagcagaagtagagcattttcatcattgcagaaagatctacggacagcactgacttagatcattagtcaacctttcttcttcccaaatatatgcatttagaaatataaattcccatgaaatgctttagttccatcccataaattttgtggctgttttcaatatctttcagttcaacattttccttttttcactgcaatttcttagaggagctatgggttattcagaatgaggaccaggactggggtgagataagcaaggaggctgaggcacattaaggagagacccacgcccagcttcaggtatggcatattgtcaccttaggttccctgcttgcctcaccctagtcccagccctgtttagaaatgtattgcctaatttaggaactttgggttttttttcagtgatctttctgttactgatttgtaagttgattcccgtgtactcagtgggtaactacaaagagccccacagctaacatcacaattaaagtaaactattctacctgagtttgagaccaagaaaagcacacccatgaaagccacttcaattcgcaaagcatttggaatagccaaggcaattttgaacaccaaagttggagaaatgaaactaccacatggaggattatgcaaagctacaataattaagatactgcagcattagcacaaggatagagaacaggacaaatgaaatgaaatagattccagaaacacatatatacaatcatacctgattcacacagtttccacggcaatacagtagggaaggagtggtctttttagtaagtggtgctgattgattttgggtatgtatatgaaaaaattagtcttcatgccttatcacaccattaacaaaaaatcagtttgagatgtctcatcaaaacagtaaagcttctagaacatagaaggaatatctttatgtcgtttgtagacaatttcttaaataagactcatgaaagataaaccataaaaccacgatttagatccaaatatgggacatttccagtgccccagcacccttcccagtcgacagcccagtttttaaaaaggtaggagggggcaaaacttgaatagacatttaataaaaagaaatactcacgtggccgataactatataatctcaaggtccattaatcctcagggaaatgcaaattaaagccacaataaggtaccactacaatttcaagagaagggcacttactaaaaggactgacagtaccaagtgctggatcagtagcagtggaattcgcagtatcggtggtgggaatgtaaatcgtttcaatcactctggaaatgtatttggcagtatctacactagacagctaaatatatgcagttccagcacttctcatagctatatacacccacgagaaatgattacatgcttaccaaaagacacgcacaagctcatagcagctttattcaaaattgccaaagaatcagcctcaaagtccatcaacagtgaaataaatttatacaaaactgccacagtcactcaacaaaattctacccagcaatgaaaaagaatgtgctactgctacacacagcgaaaatgcatctcacttattttatttcattttactttattttgagacagtcatgctctgtcacccaggctggagggcagtggcgcgatctcagctcagtgcaaactccccctcccaggttcaagcgattctcctgcctcagcctcccgagtagctgggactacaggcgcccaccaccacgcttggctaatttttctattttatgcagagaaggggtttcactatgttggccagcctggtctcaaacttctgacgccaagtgatccacccacctcagtctcccaaagtgctgggattacaggcatgagccatcacgcccagccatctcacttattttaaaaagccaaagacaagaatctttgtgtgattccatttatttaaagttcataaacaagaaaaacctctgaggtcagaataagggatgccttgttgggagcatttgactgggaaagggctcaaagactttggagctacttcttgacaatagggagctgatgagatgtcactgtgaaaaacaacctgacagttgatgacattgcttgctagcatctacagccacaatgcacatatggcctagcctcacttctgcctttcggaactcctggaagtcagtcgaacatattttcagctagaatccttgctgcaagggagtctggaatctctagtgttcatagccgtcttctttttagtttttacaggagaagactgagggtcagtgttgctaacaataacggaagccataccacttgatcctggctgaactgaagtttgaataataacttttgtttcacgagggaacccttgcagttgctccggctttttaaatgtttgatggtccttggttttgtgctctatttcctccttcaacgtcaaaaactgtagccggcacttggaacactgaaggaccctccttctgctgtgcctccaacaatgattcatgtatggtattgcagttttgaaaagtttgagacaaaacagacaaagcaaattctttgtgttttcatggcacgttctaaaatgtgtttccacatcagcaaagaccgacgatctgtaatggcaaacctggcacacgtagggcatttcgccaggcttatgatggtccttcatgtgttgtaagaggacctgatctgtttcaaatgacaattcacagattttacagacagcagagggccccatggcgatgtgtacactatcaatgtgacactgtagctggaagggagtgggaaactgccggtggcagtgctggcaggtggtgtggtcttcccagctgtcgttcctctgcttctcaaattccaaatgatgcttcatgtgattcataaacttaatattttttagaactttcacgcagctgaggcatttaaaggtggtgtgagtcttctgttccggctgcccatctcctttatgctgtccatagtaaaagttgctaagtaacacgatgggattttctttcttgggatcaaaggtcttgttttgacttgctagacttgaaatgtctgtcattgccaggccagactcatttgctctctctggatctgtaagattgaaatgtgcctttccattagcatcaggccaaggaaatgttactccattctgaacatggtttgatgagttgcagatcccctgtgagggtgtatttgtgcttattgtagaagacatatctgaagggaccacagctaaagaaggtacccctgggattccatccctgagtttaacccttttggaatctctgctgtttatatctgaagtggaaagtcgctttgaatcaggagaactctcatttctgcctcctccagagaccatagctccaactagacactgagtccctggggggagcgaatctgagtaattgggagaaacaacttgtggtgagctcattttataaccaggttcagatgaagacttcatagtgacaggactatctgtcgatcgcccctcagacagagaaacgggcatgatggcttttgccatagaggtcacatgatttgcaggctgcgacacgtgagcaggatattgacggaagtggcctttctttcttcttgactttgagcctggggtgactctgttcaaaatgtttgaaacgactggttttgaatttgaaatcatcccgacaaagagaacttcagcatctctatgtacatgctccaccccaacatagatcagatctggatcttcatcatcctcctccctttgtttggattctctcaaattcttctttggtgattccactttcttacacaaaaagatatctcccattttcaatttactttttgcttgaagccactggtctcttcaacttccagagctgtctttttacaaattgccacctaagtgcaaccatgtgacaatagtcaatatttatttcgaaagacaaaatcattactttattgtatcctcccttaaaacactgagataaccatcaacatctctattttacacgtcagaaatgaggcttgaaacattttaaatggcataataatttcaaatttacctgtctctcctcccctggtcttctgcagttgtgaggcaaaggaagcaagatttcaggaggtgcagatggaacatctcagagtgcttgcctctaaattttgcactctagatgcctcactcacctcctcctcatcccacaggtactctctcagatgtctaaggtttctaaccaacttgaacaaaacttctctcaaaaacattctgctcctagcctgggcaacatagcaagaccccatctctacaaaaaaatttaaaaattaaaaaaaattagcttggcatggtggtacacacctgtggtcccagctacttgggaggctgagccaagaggaacacttgagcccaggacttcaaagttatgttcatgccactgcactccagcctgggcaaccaaatgagaccccatcacacaaacacacacacacacaaatcacaacacacacacacacacacacacacacacacaccctttgctgttcctgtaatgttccttttctcagtaaactcagttgctcagtctacaaacttcagagtcatcctttgccagactttctctcatacactacagccaatcaattagcaaagctagtctgctctatcttttaaagatatccagaatctgactactctcttccacatctactgccacctccctgatggaaggtaccatgttctctccctggatcactgcagaagttgccagtcttaaaagttttgtcagatctccccatggtggccccaatgcccctgttaaaatatacaggggagcaagtatattttgctcttaagtcttcaatgactttccatttcattcataggaaataccagcaaactttaaatttctccatggaaccttaggtcatcatcgcccttgctaactcctctgttgctctgatgcagccatcctgagctccgtgaatctggaacacaccaggcctttttctttttcagaacttttgttgttcccggacattgcgtgcctctttccccagattaaccccatctgggctcctggtctgcctcagtcccatggttcctcttcagcaaggcttacctgaccacaatatcaaaaatcacaacctccttaactcatatgttcaaaccctcaatgttatttttcaacttagcatttatcactgcctaccacacaatatgtaaaatatatcttgcaagcccaggagtttgagattacagtgagctgtatcatgtcactgcatccagcctgggtgacagaggaaaggaagactctgtgtcttaaaacaacaacaaaaaatgggacaggtgcagtggctcgtacctgtaatcccaacactttgtaaggccaaggcgggaggattgcttgaggtcaggagctcgagaccagcctgggcaacatagcaagacccatctctacaaaaaatttaaaaatataacttgtttcttttctgtgtttacccactaaactgtatgccacatgagggcagggagttgtgtttcatttactcctcagcttatagagcaatgtctgtcatactgtgcatgctaaatctttgttaaataaatagtagctgttattaatatgatcatttaggtgtaccagaggctctaatccattattccagattctctaagcatttaatgaaatccaaatccaaatgatttaatactgttgtacaagggagaaggtaaacctgtgtgtatgtgtgtgtaaattgaaacaaaagttttgtcaaatactctaataccttcaccttaccgcaagggataggctctgataccttctatgccatattttattgattctaaggtataggcttagatttccattttaacatctctaaatcagattgcatctcatcatagcatctcatcaatataaaatacatttcacaatttgtttttgcagtatatatttttatttcatagtggaatcaaaaatgacatatctcagatccttttgtgaggataagcgtgatgcttgggttttcactcatgtgagatgtgcttccctcaaaccttgttatatcagcatgtttaacatctgatgtaaaaaaaaaaaaaaaaaaaggagagtaatgtatcttttataattgatggcatctttttttttttttttttgagatggagtctcgctctgtcgcccaggctggagtgcagtggcgcgatctcggctcactgcaggctccgccccgcggggttcacgccattctcctgcctcagtctcccgcgtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcatgagccactgtgcccggccaattgatggcatcttatagtcagtgaaaaatcctatttctttttgtaagctgacagcccactaaacttgttttgtagttctctaatggatatcacctacattttggcaaacaatggtttaagacagaaattggaaaattggcccttcccctgtttttgtacagtcaggaagccaagaatgtttcttacatttttaaggtattgttttcttactttttttttattaagatttttttaaacttgtacatttttagatttgggggaataaacacgcaaaaggaagcggggcgcggtggctcacgcctgtaatcccagcacttttgggaggccgaggtgggcggatcacttgagctcaggagttcgagaccagcctggccaacatggtgaaaccccttctctactaaaaatacaaaaattagccaggcatggtagcagatgcctgtagtcccagctactagggaggctgaggcaggagaatctcttgaacctgggaggtggaggttgcagtgagcgaagatcgcaccactgtgctccagcctgggtgacagagtgagactgtctcaaaaaaaaaaaaaaaaagaaaaaaggaatattttgtgatgtgaaaattatataacattcaaaatgtcagtgttcactataaagtgttgtggaacacagccataatcatttttttagtgctgttgtccatggctgctttcacacttctatgacacagttgagtacagtagtacccccttatctttggggcatatgttccaagacccccgaagtggatgcttgaaactgcagatggaaccaaattcaatatatactatattttttcatatatgtacatacctatgatcaagcttaatttataaataggcacagtaagaggttaagcataacaaaataattataacaatatactgtaataaaagatatgtgagatagtgcgtggtggctcatgcctgtaacctcagcactttgggaggctgaggtgggtggatcacctgaggtcaggagtttgagaccagcctggccaacatggtgaaacccatctctactaaaaatacaaaaattatctgggcatagtggcgagcacctgtaatctcagccacttgggaggctgaggcaggagaatcacttgaacccgggaggcgtgggttgcagtgagccgagatcgcgccgtggcactccagcctgggcggccagagtgaaactccgtttcaaaaaaataaattaataaattaaattaaaggtatgtgaatgcaatctctcgctgacaaaatatctttatgtactgtagatcttggcaaccttagcatacgattttgttttctttccttattatgttaaaaactttcccattttcacttaaaggaagcaagcactttacagcttctttttggcatatttcaatcgccagcattgctacccttgtactttggggccattattaagtaccataagggttaattgaacacaagcactgagataccaccaggacagtcactctgataactgcgaccgctcctaagtgactaaggtacagagagcgcagccagccaacagcatggggactcaggacaaagggaggattaccatcccagggcagggctgactcaagagcttatcacactactcagaagggctggcgacttaaaatttatgtattgcctatttctggaattttccaattaatattttggaacctcaggtaactgaaagcacagaaaggaaaaccctggataagggaagactactgtagttggagcagagaattgcaatacctaaaatatttgccatctagtctttcacagaacaagtttgccagctctagttttagaggagcaaaatgaaagatagcaaatttctcagctcaccagttcctaaagttgcgagtgcatccagatgattcagtgcagctcagtatgttccactctgggccacaagggaaagcgaagctggagcttccttgtctccacctccgggagaaatttgtccagagaccggcagcactgcttccgcaggcgaacaacgccgcttgctcttcaaagtcctttctgaggccagatcagaaggtcccactccttttaagccccttattgcccaatcatttttccagtcacgtgtctgaagcagtttatcctgattggattttcagttgttgtccagcttgattgccaaaagttttcctccaattgctactcaaaggaaagaatgagggtggggcttcagggctgctttccaggttgattgagctgctgatgggcatcctccctcctctctctcttgttcagagtctaccactttctctgcagtgtgcctgggccctcagctattggggatgagaagggatgcggagtgggaggcagtccacatgtctgttccaacaaagctcagaggtgagcgagttaaaaagcagatgtctttccagtaggagccccaggggacagggtgggtctcacagcccttgaagaccgagctcccgtaggagtttccaggtgtccaaacagggtcctcactgtgagtcttcaacagctttctccaagcagcagcccactcccttcttaatccatttccaggggtcaaaggtctatcctggttccctcccatgccctctcacttccttccctctgtctctccctcctccctcctccttcactaccccctccctggaaccttctcagctgaatttcaggcccaccctttcactctctttacaggctttgcaacacagattagaaagcgggggagggggagcctcaagagtcccttgacaggtaagaaatatttatatttccacccccattccaacgcaatgcaatcaagtctcaaaattaaaacgaaaatcatttgcaaattaaaatgttctaaagtaccatctcctgataaaactttaaaaatacctttctgggccggatgtggtgactcacatctgtaatcccagcacttttgaaggccgaggcagcagatcacatgagcccattagtttgagaccagcctggccaacatgatgaaaacctgtctcttattctttataaagtaaaatacaaaaatttcctgggcgtggccgtgcgtgcctgtaatcccaggtactcgggaggctgaggcagaataatcacttgaacccagtaggcagagcccaaggtggtataaaagtgtgtgacccatggtctttattcttgtctagggactggggaaaggctgcttgagggcattgcaagtagccaagagcatgcccctggaaaggaaggtgaaatgaggcccgctactgaggtacacctgtagtcccagctatcaaaggctgaggtgaaagatctttgagcccaggaaatccagacaaacctcagcaaaatatcaagacctctgtttctacaaaagaaaaaaaaaatttttttaattagccaggcattgtagcacgtgcctgtagtcccagctacccgggaggctgaggtgggaggattgcttgaaccagggagatcgaggttgcagtgaactatgattgcatcacatactttagcctggatggaagagagagaccttgtctcattcattcattcataaataaataagcaagcaaagtgaaatgaagtgcaagacttagacagtaaagttctaacaggggccgggcgtggtggctcacgcctgtaatcccagcgcttaggcagaggcaggcaggtggcttgagcccaggagtttgagattagcctgggcaacctggcaaaaccgtgtctccacaagaaaatacaaaaaattagcctgggtgacagagtgaaaccctgtctcaaaaaaataaaaaaagaaaaaagaaaggaagacagagaaagaaagaagtaaagaaagagaaaaaaaggaaggaaagaaaggaaaggaaatgtgtattctgcagaactgatattcactccttcctcttttccagaagcagaatcctgctaggaagattccaggaagcctaggcagtggtcaggggctggctcaggtataaagcaggcccttcccctgagacagaaggttgtggcaacaatgcttgtgggaggtgagaaaattgagaggagtgtctagaaatagctcggagttgcatcttattttcttttgctcagttttaaaagtcccaaataagaccacatctagctgttctaaccaagctattctaacccactaatctagtaaaaataaaatcacatggtctgaatataaatttgcatcaggatacatgcctttcctatgaaacatttatgtttccttataaaatgtatcctccttttctgcagaaaactaactgtaatgcatccaaaggtcacagaatgtggtgaaacatcctcatcattgatttttaaaaaaatttttatttatttatttatttgttttttgagacatggtctcacattctgttgcccaggctggagtgcagtggaacgatcatgcagtcttgatgtcctggacccgagcgatcctcccacctcagtctcccaagtagccaggacaataggcagatgccaccatgtctaactgatttatttttatttttgagtagagatgaggtctcactatgttgcctgaactggtctcaagctcctgagctcaagcaaacttcccacctcggcctcccaaagttctgggattacaggcgtgaactacccgcaccctgccctccataactgattcttttttttcagacttcactctgttggccaggctggagtacagtggcgtgatctctgctcactgcaacctccgtctcccaggctcaagcagttctcgtgcctcagcctctcaagtagctgggattacaggcatgagccaacacgcccggctaatgtttgtatttttagtagagacagggtttcaccatgttggccaggctggtcttgaactcctgatctcaggtaatctgcccacctcggcctcccaaagtgctaggattaaaggcgtgagccaccacgcccagccatagctgattctttatcagtctgcctttgggaagtttccactgggaaacactctccaggactgtttcggaccagccccactttccaaacaaagaattccagtgatgagattaaagcttgtcacaatatgtttttcaaatgactggtagaagcagaccttaagattaaaaaagaagaagaaaaaatggctgaaatcttgaatcctttattgctttaaggcacagaataggaaatggatggcgcgtcgggaatggatgcaggtcagggacagaccatcactcatgccaccttgctgtgtttatgaaacagagtgctagaagttaaatttgggggatgcacaaagagatgcctaatcagatgaactcagagttggaattgctgtttgtgagacagttacatcaaaggaagaaaagaaggagagaagaaaggtgactatcaggagaattttccagccagaagaaagacacagaggcacaggcatttcatggcctgaaaaaggaagagcacagagacaagtgtggctccagttaaaggaccagcggagatgaaagatgaggtcagtgatttgggtaggggacatagcagttaagatattgttggtcaaggctgggcgtggtggctcacgcctgttaatcccagcactttggcaggccaaggcgggtgaatcacgaggttaggagatcaagagcatcctggctaacacagtgaaactccgtctctactaaaaatacaaaaaaattagccgggcgtggtggcgggcgcctgtagtcccagctacttgggaggctgaggcaggagaatggtgcaaacccaggaggcggagcttgcagtgagccaaggttgcaccatagcactccaacctgggtgacagagtgagacccagcctcaaaatactactactactaataataataataataaaaacaaaacaaactaaaacactcaggagagattagtggtctaaaagcatatttttacaatgtattcagggttattccattgtttcttaaaaactacctttgggagcatctccccaaacttagtttggaagtgttttttctgggttgcaataaacaagcaaacaaaaaactaccttttaattaaaagtaatccttaaatagagctaacaataaaatcaaacacacaaaaaaattatccattttaaaattttttttatatgaagtcttgctctgttgcccacccaggctggagtgcaatggtgccatctcggctcactgcaaccttcaccccccgggttcaagcaattctctcacctctgcctcccaagtagctgggactacagtcacgtgcgagcacacccagctcatttttgtatttttagtagagacagggtttcacaatgttggccaggttggtcttgaactcctgacttcaagtgatcccctgcctcagcctcccgaggtgctgtgattacaggcgtgagacaccgcacccggccaaaattcatccattaattgtaaagtaaatttcccttctgccccagatcacagttacctgtctctattcccaaaataaatggctgtgtagaatttctgatgtgtccttcaatatatattctctgcatctacatacacttaccttcccctacctttttatgtaaatgggtgtttattattcacatactccgtattaaaattgtgatttattaacataattttactgacattttaatttgaatggagataaatttataaaggggattgatgattaagattttatgtttaaatattcggaagcaaacagtaatgcatcttatcttctgagtaggatgtgggttgaaactgcaaaggcaagcatgagatgtttcattaacacaaagccttgagtgctccaaacccaaaagtcaaagcaacttatcaataaatgccaaaggatgctattctgacatatctgtgtgctgtggtttgaatgcagactccaaatctcatgtgtgggaaacttaatttccaatgtgggactattgaaaggtggggcctttaagaggtgattgaatcatgagggctctgccttcatgaatgaattaatccattcgtggattaatgggttgatgggttaatggcttatcatggaaggggagctggtggctttataagaagagaagagagacctgagccaacatgctcagcctccttcatgagatgccctctgcggcatcaggatgctgcagagacccccaaccaggtaagaaggcttttaccaggcatgccccctccactttgggcttcccagcctccataactgtgagaaattcattttctttataaactacccagtttcagatattttgttgtaagcaacagacaacggactaagacactgtgttatctaattatgtgattcttgttttactatttatttatttagccacttgtcagaaaaatttttttttttttgagataaagtctcactctgtcacccagactggagtgcagtgctgctctcatggctcactgctgcctcgaactccctggctcaaacgatcctcccaccttagtttttcaagtagctgggactactacaggtgtgcgccaccatgactggctactacttttttttttttaatattgcccaggctggtctcaaactcctggcctcaaaagatcctcttgcctcagcctcccaaagtgctggcattgtaggtgtgagccaccacacccagcccaccaaaagttttttcagacatgtacctgagtgattaagagtttaggattggctgggcacggtggctcacgcctataatcccagcagtttgggaggccaagacgggcagatcctgaggtcaggagttcaagaccagcctgaacaacatggagaaaccccatctctactaaaaatacaaaatttgccaggtgtggtggcacatgcctgtaatcccagctacttgggaagtctgaggcaggagaatcgcttgaacccgcaagggagaggttgcggtgagccgagatcgtgccattgcactccagcctgggcaacaggcaacaagagtaaaactctgtctcaaaaaaaaaaaaaaaaaaagagtttaggatctatattcgctctgcctgggtccaaatcctggatgttattaactgtatgactttgggcaagtttattaacacctccattttaaaaaaatctgtactaggaatataataataaatgcataccctctcaggatttgattaaatggaataaaatatatagaattcctagaacagtgccaggagtttgaggccagcctgggcaacatagtgagaccccatctgtacaaaaaatacataaaaaatgaggggggaatagcggtgcacacctgtggactcagctacttgataggctgagatgggaggattgcttgagcccgggggccaaagctgcagcagtgcagtgactgcgtcccagtaatcccagcactttgggagggcaaggcaggaggatcccttgaggccaggagttcaagaccagcctgtgcaacataaagagactccatctgtacaacaacaacaaaaattcttacgcacttagtatttgccagatataatgccaatttctagggcacaaaggcaaatggtaactacctccctggattgttgtaaaaataaagcatgcaaaacattttgtgcccccaatgatcccttcctcatggtgtccccacacttttattttgtgctgtcacaatgagcagggcaccaccaggatactgggaaataatgacgtgtgatttccaagaccaggtcacaaaaaacattttgccttgccctcttgaatcacctgctctggtggaaaccagacaactgttatttatgtcatagcattcaagcggccctatggagaggtccatgtggtaaggaactgaggcttcctgccaacagccaagtgaaagagccatcttggaagaggatccgcctcccaagttggccaagccaacattttgagtataacctcataagagtctctgagccagaaccacacagctaagctgcagtaactttgaagtaataatgatttattgttgttaagccactaagttttgggataatttgttatgtagtaatagatagctaatacagttgtgcttattacgtttggtactcgttactatcaccaccacatcagtgcattgtagaaaacaaattctatgtattaaactgttttgtttcccctctggattaagctgggctcacaaggggaaaggtgcccaccagagtttttttcttttttatgtaatcaagtttttaaaattttattctattctactttatttttttaagttccagggtacatgttcaggatatgcaggtttgttatgtaagtaaacatgtgccatgatggtttgctgcaactatcaactcatcacctaagtattaagcccaatatgcattagctctttttcataacgctctacctccctcctaccctcccgtaaaaggccccagtgtgtgttgttcccctccctgtatccatgtgttctcattgttaagctctccacttataagtgagaacatctggtgtctggttttctgttcctgcattagtttgctgaggataatggcttccagcttatggatgtatagtattccatggtgtgtatgtaccagattttcttttttcttttctttttttttttttttttttgagacggagtctcactctgtcgcccagctggagtacagtggcatgatctctgctcactgcaacctccgcctcccgggttcaagcgattctcctgcctcagcctcccgagtagctgggattacaggcgcataccaccacgcctggctagttttttgtgtttttagtagagacggggtttcaccgtattagccaggatggtctcaatctccttacctcaggtgatctgcccgcctcggcctcccaaagtgttgggattacaggcgtgagtcactgcgcctggtcagtaccacattttctttaaccagcctgtcgatggaaatttgggttgattccatgtctttgctactgtgactagtgctgcaatgaacatacacaaaattatctgaatgattgcagtaaacatcatatatttgtttgccagctaccataataaaataccatagattgggtggcttaaccaacagaaatttattttcccacaattctggaggctggaagtccaagatcaaggtgttggcagggttggtttcttctgaggccttggcttgcaagatggccaccttcttgctatatctttacatgatcattcctctgtgcgtgttcgtgtcctaattttttcttcttataaggacaccagtcattttggattagggctctttcatatgacttcattttaatcttaactgcttctttaaaagccctatctggaaataaagtcacattctgaggttactgggggatagaattacaacaaatgaattttgggaggacacaaatcagcccataacacatcattgccagcatcacatgtggagcattcaactggagaaactgccctaatttctcatttgaaggtctaaacatctcttttatcaaaataagccaggttctattaagaaggctgaatgtgcatctggctcgatcaacaggcgtctggctgcttcaaatgcttgatttttttcattctcagagaatgaaatcaatgttgaaatattgagtatattctatacaaaatcttcatgtcacaatgaataagaaaagtagttttttttgagacaggatcttgctctgtagctcaggctgcagtttttggagtgcactggtatgacataactcgctgtagcttccatttcttgggttcaagtaatcctcccacctcagcctcctgagtagctgggactataggcatgtgctaccactccaggttaattattattattattatttttgagacggagtctcgctctgttgcccagcctggagtgcagtggcgccatctctgctcactgcaagctccgtctcccgtgttcacgccattctcctgcctcagcctcccaagtagctgggactatagacgcccaccaccacacctggctaatttttcgtatttttttagtatttttttgtatttttttaatagagatggggtttcaccatgttagccaggatggtctcagtctcctgacctcgtgatccacccgcctcagcctcccaaagtgctgggattacaggcgtgagccaccgaatccagccactccaggctaattattttattgtatttttagtagagatggggtcttgctatgttgcccaggctggaatcaaactcctgggcttaagcaatcctcctgccccagcctcccaaagtgttgggattataggcaccagccactgcacccagtcaagaaaatattttctaatactgaatacagctaaagaatggatggtaaaccattattgtccagtcaggatcactgtcatccaagtgggacactcagtatttgagattctgggtggtgctataatacttgttgccttggtatctgagtgagcacttagtctaagtataataattttctggaggagtatattagggttctccagaaagacagaaccaatagaatggatgaatagatagatggatagatagatagaaagatagattgatagggccgggcgcggtggctcacacgtgtaatcccaccactttgggaggccaaggcaggcagatcacgaggtcaggagatccagaccatcctggctaatgtggtgaaaccccatctctactaaaaatacaaaaaactaaccagacgtggtggcaggcacctgtagtcccagctactcgggagctgaagcaggagaatggcgtgaacccgggaagcagaacttgcagtgagccgagatcacgccactgcactccagcctgcgacagaacgagactccgtctcaaaaaaaaaaaaaaaagaaagatagattgatagatagatatgtgagtatgtgaggggatttgttaggggaactgtctcatgcaattatgaaggctaagaagttccacagcaggccatctgcaagctggagatcctgggatgctgacagcatggctcactctgagtccaaaagcctcagaactagcggtgtaattctcagtccagtgctgaaggcctgagaagctagggagtgagggtgcactgctagtgcaagttgtggagtccaaagaccagagagccttgagttgtgacatctaagtacaggagaggaagagtgtatctcagctccaaaaggtagatcaacacattcacctttcctctgtttttgttattttcagtactggcctttggatggcacccacctacatggagggcagatcttccccacctagtccactcacactcatgcgttaatctcttctggaaacacagacacacccaaagatagtactttaccaggtttttaggtattctttaatccagtcaagatgacacctaaaattaaccatcgcaagggtatattcaatctgaatggccaaaattatctgatagagccttcagatacttgtacttaacagatgtactcttgggattaaatgagtttatgctcaagaaatgatattagccaggcataggggtgcatgccgttgtcctagctaccgtggaggctaggacaggaggagcattgcttgagactgggagcttgaggctgcagtgagctgcgatggttccactgcactccagcctgggtgactgggcaagaccccactgcaaagagagagaggcagagagagagagtagaaatggtatctgttattttacattaaaagttctggaataggggagtgctatggtctgaacgtatccctccaaagttcatgttggaacttatgacccaatgtgatagtattaagaggtggggcttttacgagatgactaggctattagaggcctacccttatgatgaatgaattaatgtccttatcaaaaagattccatttccactatgctgagagcggaaaacaaacaaacaaacaaacacaaatgaggttccacacagcactcatcctttttgcccttccacccttctgccatgtgaggacaaagcagcaagtctccattttggaagcagagagcagccctcaccaaatctgaatctgttggtgccttgatattgaacttcctagcctctagaactgtaagaaatgtttctgttttgttgttgttttttccgagacgaagtctcgctcttgttgcccaggctggagtgcaatggtgtgatcttggctcactgcaacctccgcctcccaggttcaagggactctcctgcctcagcctcctgagtagctgggattacaggcacgtgccaccacgcctggccaatttttgtacttttagcaaaagtggggcctcaccatgttggccaggctggtctcaaactcctgacctcaggcgatctgcccacctcggcctcccaaagcactggaattgcaggcacgaaccaccgctcccagctgagattttctgttctttgtaaattacccagtctcaagttattttgttatagcagcaaaagcaaattaaagaaggtataatatcaggctctcttctgattccctaggctctgctgcacgaattgttatttccagaagttcccataggaagttctcaggaaatgaaatggatatgaggtaacctcatgtcggggagtcagtctatggaggatcataatcatacaacaacatggtccacccttgctataatctattttttttttttttttttgagacggagttgctctgtcacccacgctggaattcaatggcgtgatctacgctcactgcaacctctgcctcccaggttcaagagagtctcctgtctcagcctcctgagtagctgggaccacaggcacacaacaccacacctggctaattttttggatttttggtagagactgggtttcgccatgttgcccaggctggtcttgaactcctgagctcaggcaatttacctaccttgccctcccaaagtgttgggattacagtcgtgagccactgcacccagctgttttctgttttctgacttttatttttgagacagggtctcgctctgttgcccaggctggagtgcaatggtacaatctcggctcactgcaacatctgcctcccgggttcaagtgattctcctgtctcagcctccacagtagctaggattacaggcgcctgccaccacacccagctaatttttgtatttttagtgaagacatggttttgccatgttggccaagctgttctcaaactcttgacttcaggtgatccgcccaccttagcctaccaaagtgctgggattacaggcacgagccactgcgcccggccttgttttctgttttgtttgtttgttttttaagagatagggtcttgctctgtcagctaggctggagtgcagtggcacaatcagctcactgcagccttgaactcctgggcccaagaaatcctcccaccacagccttctgagtagccaggactataggtgagcactggttaaatttttaatttttttttgtagagacagagtcttgctatgtagtataggctggtctcaaattcctagcctcaagtggtcctccagcttcagcctcccaaaatttgggaatttcaggcatgagccactgcatctgaccgtacaaaatgttaataaactggccaggtgtggtggctcatgcctgtaatcccagtactttgggaggctgaggcagggagatcacctgaggtcaggagtttgagaccagcctggccaatgtggtgaaacccccatctctacagaaaatacaaaaattagccaggcgtggtggcccatgcgtgtaatccgagctacttgggaggctgaggcaggagaatcgcttgaacctgggaggcggaggttgcagtgagccgagatcagagcactgcactccagcctgggtgacagagtgagactccgtctcaaaaaaaaaaaaagttaataaaccttttactcctggcctcaagtgttccggctgcctcagcctcccaaaatgctgggattacaagcatgagccatttatttttctttttttgagacgggagctcactctgttacccaggctggagtgtagtagcatgatcacaactcactgcaaccttgaactcttggattcaagtgatcctcatgcctcagcctcctgagtagctgggactataggtgcacactgacatgctcagctcattcaaaaattttttcataagagatggagggggggtcttgctatgctgcccagcctggtcttgaactcctggactcaagcgatcctcttgccttggcttcccagaatgctaggattacaggtgtgagctactgtgcctggcttttgatttttagacagggtcttgctctgttgccgaggctggagtgcattggtgtgatcatagctcactgcagccttgaattcctgagtttaagtgatcctcctgcttcagtctcccaagttgctaggactacaggtgtgtgccaccacgcccagctactttatgaacgttttgattccaaagtctgaaaaaagttttccagattcatctccaggtcaaataatgtccctgctgtcaggcatcctgctttagaagcaagatgtagcatttttcttcctttacttgcagcaggcagctaataactgttatcctgtgctggaccatccatgttctacgcattctaacatgtgctttacataaaaaattagcccaagtgaccctcactgtgacattacacggtacgtattattaatctttttttttttttttttttttttgaggtggggtctcactttgttgccaaggctggagtacaatggctcatgcctgtaatcccagcactttgggaggttgagttgggaagatcccttgaacccaggacttcgagactagcctgggcaacataggaagacccccatctctagaaaaaataaaaacatagccatgcatggtggcatgtgcctgtggtcccagctacttgggaggctgagaaaggaggatcacttgagcctgggaggttgaggctgcagtgagccatgatcatgctactacactccagcctgggtgacagagtgggaccctatctctaaaaagagagagagagagaaagagggagagcttttaaaaaatggcaaaatgtgcccacagctgatgggcctatttttcttttttttttttttattgagacggagtcttgctctgtcacccaggctggagtagtggtgtgatctcggctcactgcaacttctgcttcccgggcttaagcgattcccctgcctcagtctcctgagtagctggaaatacaggcacccgccaccatgcctggctaatttttgtatttttagtagagacagggtttcaccacattggccaggctggtctcgaactcctgacctcaggtgatccgcctgcctcggcgtcccaaagtgctgggattacaggcgtgagccactgcacccagccaatttctatttcttatagagcttacggtaggaggcttgaagatgggaacagaagaaaaaaggttgaagggcccagctgctgtgtgttgcaagacaggaaattgctgacagtctgcaatgccagcagcctcatgggtggttatcaccaggacagaggcctcagaacaggcaggactgggtgtgctggcactcacggctacgtgcagatagagcccgcccctgggccttggtgtgtgaccttcttcccaggtgcttctttgggaagctgtacagtgagggagatgaggcagactaagggcaggacacactagcataggagcggtggcagctaagtaggctgactgcccagggattgcagagttcacctgcacagtatgacatctctcatccttttggatagattgttctataaggtggcctccacctacccccaactcccaaatctgacattcattcatctacttcccctgaagtgctccctagcacttgccatgagtttgttcactcttgggaccccaaatccaaggcatctcactggctgagattcagtttaccacctcattgatggggggactcttatgtcacagaagtaattttctcactgataggacccaagatgtcgtcctatttttaatgtgggtacaaatactaagtaaatatgatcttagtgttttgccaaaaggaattaagatgtttttaatgggtcacaaattcagaaaggggttggacctggtgggacaggttggtgaggcccagaagctccacttcaagtgcagtactggacatccccttccagtacgggaggtctgacttgtgcagtcaagcccaatactggcacagccacaggccagggatggaggcttatgagtccactggaaaacagggaggactgagtccagggtctcaagggtttagtagtgagggctcctgtgaagaacccttcactcagtggtgttcattaccggccccttccttagtatgttccaggccctgaggatgtaccttgcatgctctgaccctttgaacaccaaagaaataagcaaggagataacagatgccccaaagagatgaatggtgtcatgagatctgggggctgggaccttgtccagcctaaaggtgtaagtaccatggatgagcagtgtcttatttaatcagcaactagagatttcctgaggtttaactgggaaagcaggttcatatactacaagacaccaggtgcttcacattgcttctctttattttcaacagtttctttacaacagtctacacagggattaactcctacatgtacttcccaagccagaatctccctttagaaattcagattctatttctaactctataagatgtatctccccaaagatcacattaactcctcaagtcaacatctgcctatccccaacttcccctttttttcctcactgaacatttgtctgaatgttttttcctcactgaacatgttttcctcactcacactgaacatttgtctgaaactgtggctgctttgttgcttcaagatgcatgcacatcctggctttagtgtccaagtatgcagaatgaagcatttgatatgtgcacccagctagttaggcatgaaacaggggcacaggatgggctccgggtcatagaaggttctgtccccacagtgaggacaggggttggcactaagccagaccatgctgggccgccccaactcacacagcaactccctgagcctggcatgcagataggcaagcctctccaggtggagggtaccatggatgtcctcataactctccagggggacaggatacagcacgtgggtcagattgctcagcccgatgaggtgctgcaggagactctgcaaggcagatatggagatggaattcccgtagaagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaagcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaaggaaaggcatcagtgaattttagtatttgaagatacaactgaaaatactttctttcaactcgggcttccttctgccactgcctgggccccagtcacctctatctctgtgcctgatgaagctactagggagtattcacagtggacaaactggggcaaggtcagcaacatccaaagggggttcccaggctgcagggctaccttaggtcactgtatcatcagcaaaccacctatcaatttttgcaatttctctgttgttccttctcccacatctccagaatcctgcatttcccacctattaccctaactggaattctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgataccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggctgagctgcttctggctctggaaatgagtacagactggccctgtttccagaccatacagtccagaagtcctgatgagagttcttccgtaaatccagcacttgaagtttccacctcctgtggggaaaaacaggtaattagctgagatgatgctttaagatcaactcaaaataagaccatgagtctcataatgtaggtaagaaccaaacagacatccaccttagatctgcacttttacttcgtacttcaggcatcagctgctccctttcccactaggatcctgggatccttcctggtccccaattcccaccccaccaggaggaagcaggtgcatgttccttcagacacctctgcattttaatcagtgccccatgtccagaagcccattccaagagtgacccctgcagtagccccaaggcctccctgaacttccttgctggcaaccatcagagcctctggcccagccttaggcgctccatgctccctgaccccagctgcatcctgctcaggttcccagggccccacaccaagctgctaggtcacccttacctggggcgaacctcctgggcaaggagcacatcaagtccatcaagcacagctttgaaggtctccaggtgaagatgttgtcccttcatcagcactcccagagggaggcaggtgaagggccaggcctgcaccattgccttcagggtctggctgtgtctcccgtcaaaggctgccatgaagagtggcgggaagagctccctgggcagcaactccagggcggcaatggccagggcctcatccttcagcaggctctgccctgccagctccacaagtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcttgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatcttgtatactagatatcttgaaaaagcctccaccctccagcacagtggctcatgtctgtaatcccagcattttgggaggccagggtgggagaatggtttgagcccaggagttcaagaccagcctgggcaacacaaggagacctcatctctattaaaaaaaaaaaaaagaaaaaaaagaaagaaaatgtctttaattccaaagcatctgaaaagaaaaagaaaaaaatctatggaatattttttaaccttttagttaaaatggaatattttttaaccttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacatactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccagacctctgggaagaccacaacattgactccatggcctctgggtccctcctctggcccctctgaagctattacaggcctttctgggcatacctcccctttcaactccacgctgccaacggaagagccaaatctaattacattcctggatctccagccagtgaatcctgatggggttttttacttacttcaggttcaactgattgaatgggatgtctatttacaaaaaggaaagaaaaagtgaacaaaaccacccagagagtataactgttaggggaatttttggccacatcaaaattacccaaatagtccagttaagatagctttatgaagagcatcatgacatcaccccttcccactcccaaacaatccccaagtatcaaattgtcacttataccccatgttccctaacacagcaaatcacatgcctatccaaggaaaaagggaggaacaacagaggggtggctggtcttccagactttgaaagtcaaggctgtcctgaaggaaggtgggtcaaaattacactacaattaggagttagtcagaagtaaggctgggcatttgtaatgggactgagtggattaccacaaagacagataggtttttttgggggcggaattgaaagactttggcctggatggagtagagaaattaaaaaggggaatggctaaggaagatgaaagatagttccagtaaagccaaggtaatcactgaggcagggagggagttcaatcttcctccctccctagagggaaagggtgttttctcccagaaagtcaggatcctcttggcaaacagccttgacaagattaaatctaggaatgtgggctggagaggtgggatagagagtaatattggtgaccaaacctaggacagcaacattttcaagtctgaaagaccttgtggtttcttaggaatcttggagccaggaaagaaataaacaagggctgaaagcacacatccctgcaattaaagaagttgtcagaagaccttctctttatggttaggtgtcctcttccacactggggctgttcacaagcagcaggtcaggcctttaccacaaacataatctccaatggccagccccttcctaagtattactaatgtttccacacttcaagaaaacagctgttctttcttgcccctaagctgctcaggtacagagattctggtcagcgagatgcaatcaggcctatcaattagactcagtttttctctatttccatgctaggcacagtgcacaaatacattttccgtcacaaaaaattgaagttatatttggcatttaaggatctgcttagggatgattcctatcctgggcctgatcacccactggtgcttttgaagttttggaacctctccacccaaagaattctccaggccattctctgcctcatgcactgtgaagtccctacaattcttatattctactggcaagtgtccagctggaatgtcttgcggcctgactttgtttactgtggcctgcgtaaggaggctgtaattcgttgaaggatgttttccattttggttctctctctggagactttctcctacttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctactggttcttatggtccttgtgggctgcacaggccagagtggcctctgagctcatcaggtgggtggtctgcaccctcctctctagtcatagaatcccagtggggacccccgaagtatctgcaccaggtccttcaggtgttttttttggagtgcagtggcgcaatcttggctcactgcaacctctgcctcctgggttcaaacgattctcctgcctcagcctcccaagtagctaggattacaagcacacgcccccacacacggctatatttttgtatttttagtagagatggggtttcaccatgttggccaggctggtctcaaactcctgacctcaagtgatctgcctgtctaggcctcccaaagtgttgagattacaagagtgagccaccatgcccagcctctttttcttttttagagacagggtcttactatgtttcccagactggtcttgaactcctgggctcaagtgatccacccatttcagcctcccaaagtgctgggattacaggcttgtggataccaacagcacccgagcacggtcccacagtccaacgcactgtgccgtccttgagcctttagttccagcacaagtctcccggcttcaacccaggttgcatgttctccctgatctccccaggtggcacccaaggatgaggcagtgcaatcttgttgctcacttcccaggaccgacacttacccctaatggcccaagcccatggggcagtgagatcaaagcctcctggagctcatactctctgacaccactggaagtgtgggcttttgcgtctgattaccccggggaaaggttctgaatgtaatcgtggctttggcaataaggtccacaatgcattaagatttttttttttttttggaggaggagtttcactcttgttgcccaggctagagtgcactggcaccatcttggctcactgcaacctccacctcctgggttcaagcgattctcctgctcctgtctcagcctcccaagtagctgggactacagatgtgggccaccacgcccagctaattttttttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcaaatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagagagttcaccacaccgcgaagttgctggaaggaaagaacgagacaatggctcagctaagcgccctagccgctgcgtggggcggggggggcggcggtgggggccggggggctgggcagcctggtctgaccaatccccgtttctcagtccttccagggcaaaatctcacgagatccagtgaggtcgcccagagagtcgagaggggcttgttttcaaagactgggaggaggaggggcagtgggggaggggcagtggggggaggagcagaggagaagggagcaggaggaggggaaaaggggagaggaagttggagagcagaggaggctgggggtggggagcagatgggggtggggaaggaggggagatgggggtggggaaggggggcgggaggagggttaggaatgggggaaggaagacagggtgggggaggggtgggcatgggggaaggaagacagggtgggggaggggtgggcatggggaaagggagacagggtgggggaggggtgggcatgggggaagggagacagggtgggggaggggtgggcatgcgggaagggagacagggtggggaaccgagaagaaagacagtggggggggatggaggaaggaacacagggtggggtggggggtcgggatgggggaagggaaacaaagagtggtggaggcgtggggattaggaacggagacagagggtgggggaggggtggggtgggggaagggagacagggtgggggaggggtgaggatggcggaaggtagacaaggcgggggaggggtggggatgggggaagggagacagaagggggggaggggtggggatgggggaagggagacagaaggcgggccagggcgggaatgggggaagggaaacagggtgggggtggggatgagagaagacagaggttgggggaggggtggggatgtgtaagaaaaacaaagggttggggagggggagggaaaagaggcagagagtgggggagggggtggggatgtggaaagaaagtcagaaggtggggggtgaggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcgactccccgtgtttccactctccacagaaatccacgcattcacgcccctcccctcccccgagcctgcagaggactccgccctgctttccctacattcagggctgctccttttgtcgccaatacaaacctgttgacaggtcacgcctgggaagcgggtggggtgtcccggagcggtgctgaggcgctgcaggcccggcttctggctgcgggggagctgtaccctgaagcctcgccggaactcgcgtctggggccagcagggggcactagagtcaacagggactgtatgcaaaacccacttcctcccaggccctctagggggatggtcaggcttctgcagagatggggaggatcctttcctggtaaggggagagggacgggctaggagccaagcggaaggaccccgtgttcaaggcccttcaagggacgggacaggcgaggaatctctttgagtcttttgaattgttttatcagtcaggcctgggaagtactccgcctccacaaactctgttttcctgaaaggggtcgggggggggaccccaacatctcctgccacaggctatgatgggcatggtggctaagagcaacaggccgcgtggtgaggctggctttttgtggctctgccctgccattccccgaggcatccccatgccagtgaacagagctgcgggttcccagctgcacagatgaatgcacgaacaaaacataggtccatacaaaggaagtcattgcattgatccagattcgacctgggattgtcgcataaaacagggctgataaaaaccgtcgtgttttcaccctggaaacagagactcagcctccccctctttgcttgaggcattcagcaaaggtttgtccttgagtggctgtggatgctcaaggacttacgatttctgactttataaagtttagggtgaaaacaaaaaacaaaataaggagaccattgttttaaagtggccgttgtagctaattatctcaagaaagcaaacaggctggtactgaaagttacacaggcgggcggctccctgggagggttgcccagctctccttttctgagacctgagcagggagcagccagaggagcttgaagggatggtgttcagggcatgggaacaggctgcacacatcttcacggagtacggtgcttgtccagtttgagaagggaaagaaacgggagcagagggctgatgagaaggcagcagatggatagtgcgggattgaaaaggggatccatttgaagactggccaccattatttattttcatcatctgattgctgttgctccattgagatcgatgcgtggagaacaagttggggagtggaacaaatggcagggaggggagagaagtgagtgaacatgaccctggtccagcctcataggacagagcgtggtcatgaagtccacagaggaggacaggtagggaggaatcatggcatggccaggttgtagggcaagaggcagagaggagagaggattgtggaggatgcctgcggagtgccgactgtcagtcgaggctggtcctttatttatttattttttttttttgagacggagtctcgctcttgcccaggctggagtgcagtggcgcgatctcggctcactgcaagctccgcctcccgggttcatgccattctctcgcctcagcctcccaagtactgggactacaggtgcccgctaccatgcctggctaatttttttgtttttaatagagacagggtttcacgtgttagccaggatggtcttgatctcctgaactcatgatccgcccacctcggcctcccaaagtgctgggattgcaggcatcagccactgtgcctggccaaggctggtcctttcttttatggcgatgggtgtttgaaagttgcacataccaaaataaactcactatttgttgacccaaagtaaaaccctgagggtatgaaagggaagggctcatgcttacatggctgagataaaagctgtctcaggaagctgggtgtggtggctcacccctgtaatcccagcactttgggaggccaaggttggaggatcccctgaggccaggaattgaagactagcctgagtgatatagcaagaccccatctatatttttaaaaagggttggctgtctcgggacttttcgaaatagccctgcaagacattcctgttttggaatcacaacaatttagataagatgcttttgaaagaacacctgcctaggcacagcgtctccaccaatgaactgatgccaactgtggttttgagtcttcataaccggtgaactgtttgcaagcagcttatttaaatctctttttttgccaatacaaccttccctttgccctcccctcttgagatgcatatatggcttgccatagctgagcatcttaggttataatgctttttctcttttttaatttttttttgtaaatttatatttatttttatatttatttattttttgagacagggtcttgctttgtcacccaggctggagtgtagtgcataatcgtagttcaccactgcctccaactctcgggctcaagcagtcctcccacctcagcctcctgagtagctaagacaacaggcatgcaccaccatgcccagctaatttatgtatttactttattaaaaattttttttttttggtagagagagtctcactgtgtttcccaggctgggcttgaactccaggcctcaagtgttgctcccaactcgacttcccaaagtgctgggattacaggcatgagccaccatgcccagcgtataattttgtattctaattcctgaataaattcaacaaatttggaggtgttttttgtctgatggttccttttggtcgacaactggaatgggagaggaacagtgtgagggcaaacatcaagtgctttgctgagctccgggtgctttttttggataagacacagaaaatacaataagatgtctgtaatgtttgatttttttccaggtttcttgaggtataattgacaaataaaaattgtatggattcaaggtgtacaattcatatacattgatccacatataccttgtttgatgattaatcaaattagttaacacatctttcaccccagcagtcaatgtgtgtgtgctctgttagcaaatttcaattaataatatagcattattaactatagttactatgctgtatattagagtctcaggatttaccatcttataactaaaattttgtagcctttgaccaacatctctcattcctcccacccacagcccctgggaactaccattctactctgcctctatgagttccactttttgtgtttcttttttccctttcctttaattttttttgtatttgttatattaccaaaccatgtcaaaagagttccactttttagattccacatattattagctcgtacagtatttgtctttctgcatctggcttatttcacttaacataatttcctccaggttcattcgtattgttgcaaatggcaagattcccttcttttttatgactgatgatgtctgtctgcaatatttgaaaaaaaaatgcagatcacgtgaatgattgtctaatgtaattctattcatgtaaaattgtgtatgaccataacagtcactcattcattgcttcgagttctttacaatcggatgccatattcctggggctctgctaggcctgaaatggggagtaggagttacaaggttcctgggatatcagtaattcatatttgtgaatgtcttagataagtgggctaacatgtacagaaaatggtcactaaaatgataacactgtttgttataaaatacttttctgtattctcttgaactttttttttttatcatttattagactgcttcagctgccataacaaaatatcacagactggatggattaaacaacaaaaatttatttctcacagttctggaggctgggaagtccaagatcaaggtgtcagcaaggtgggtgtcattctgaggcatcttctcttagcttataggctgaggccattttgcgttgtgctcacgtgacccctttgtgcgcatgtgtggagagagagcatgggtgcttcttcttataaggatgctgaaagttatgagaacccgacccttgtgacttcacttaatcttaattacttccttagaggccccatctccatatacagccacaatggggattagggcttcaacatatgaatttgtggtggggggacgcaaacactcagttcataaacatatgatttttttttccttgatcggcaatgaaaatagaggtatcttcattttggaaagtgagagtcaacctgtgctgaattagagtgatgacaagagatactttaagactgcaatgagggaagcaagggatggggacgcatttgacagtctgttctgctgtgctcctggaagtgagagaggctgagtcgggactaacctttgcacggatgagatagagaactgagagagaaaagtatgtatttttctatgaccacctaaaataaacctggagttgaagggaccagcactctcaacctaaccattctgggaataaaaatcatagagacctcgctgattaatggaaacaatttgcctttcgattttctaagcaggtgaatgcaaggagtttgtgaactttactgctgttttcgtgtttttttaggtgaagacactgacagtaagaaaaggcaaaccacaggtccaagacaaagtggtcaagtcaagaaggaactcaggctgtgtagtcctggtgcaaggctccttgcccccagcgtggggtcacactggctggctgtgctcccacgacacttagtgcatactgggctcctgacttaataacacgtgtttgaaatggcccctgattcccaatctgctgcaggattctgcagatgcgcaacaggccacagtggaaggtcttggagagaattcagagtggcttgcctacgttcccatgaccgtttgtcctaatgggagaatcaccattttggaaaattcttttggaggccaggcgcggtggctcatgcctgtaatttcagcactttgggaggctgaggcaggcagatcacctgaggtcagaagttcgagaccagcctgggcaacatagtgaaaccccatctctactaaaaatacaaaacttagcctggcatggtggtgcacacctgtagtcccagctacccgggaggctgaggcaagagaatcgcttgaacctgggaggcagagattgcagtgagccaagattgcaccactgcactccagtctgggcaacagagtgagactctgtcttaaaaaaaaattcttttggggctagctgtgaatgagctcagagggaaaggcaggagccttcaggtagggagcagcatgattccaccccagattcaggcctcctgggtgtacagagggcaggaggatcctccccaggtatgtgagaggaagggaagatgaggtgtttgggtcagtgaacacactagaaatccaggtgctcactgatggattgtgcttggcatctctgttctgccaatccagcctcaaagcaactttggaagaggatttatgcgcttcacacgcttccagcttgggccagagcatctgcacactcccctgggtataggcctccagggcttggagcaacggaagagctaagaattgtcagtgctcaggaggcagattttcagggaggatcctcttgcatctcaggacatggaaagggctaacagagccttaagtgtcctgtcccagtgctggggtctcagaaggcagctctggggcatctccaccatggtctgacttctgctgcttgaaaccattctccctcacggcacaggcaagagtcctcaaggaagagcacctgggcacctgggttgactcttcctctctccaggtggagagaaccagtagagtttacctggggtcatgctctgagttaatccccctctgcatttctttctcttctcaggggcctgggctcagccttgactcagccttcctcagtgtctgggacttggggtaaacagtcaccatcttctgcactggaagcagcagtgacattgagggttctaaccatatctcttcgtacctacagtgcccaggaactggccccacactcctcatttattatgtccattctcaacccttagggggtcccagcttgattttcagtctctaggtctggcaacacggccttcctggccgtctttggcctctagcctgaagatgggcctgacagtcactgtttgttctgggacaaccatagcatttttacccacatgtgctccaagtccacggggaacagagaccaaatctgccatgagtgaccagtgtcacagggcttcacaccagtcaggcagtcagatggtggtgtttgctttcatttctgctcatcatcccaagggggtggacgcttcaggaatgggaccctatgcaactctcattgctctttataatgatgtgggaaagagaaaccatctcccaggggacttggctttgcaaaaatgaaaataaaagctccctcctccctctgtgcagtgaatggcctctgaatgcagacttggtctccctcttcagtggcaaggttggaggaagaacaacagcttcttattgcactgagacaactcaggggccacctcatttgaagatgtgcatcagtgtgagcccaggtattcctgtactcaatgatcgaggtctctctccttaccttgtctccacctggatctgaccaaagtgactgagatgatccaggttctagttttctcttgctgtgtaacaaatttctgcaaacctagcaccttaaaataacacccatttatgatctcccagttttcctggatcaggagtctgggatcagcttagctgagtcatctgttcagggtcttcccaacctgaaatcagggcattagcttggctgtgttttcatctggaggctcaactgaggaagattctgtttccaaacttactggcagaactcacttccttgctgctatatgactgaagccaaggttttggggggctatttgccgtcagtgcccgaagctcctagagttcctagaggtcacccatagctcttttgccatttaatgtaacctaatgaaaagagagatattccatcacctttgccatatttattggttagaagcaaatcacaggttcttcttgaattcaagtgaagagattgtgcaagggtatgactcatttggggtcaccatagggtacatcctcagtaattgtgtgcagtcaggactaggggaggagattctaattatacagagaagacttgtgccttctattcagaagttaagaagacatcctttactttttaagacactctgtcattttattcattgatttttagtggtgttctagaaagcagattttccaagcgtaaagcacaataatgaaatggcagagctgatgacagttcagatgctattagatgggtgtgcagatctaggtttagagccaagggatggagtagtgtctcttggtctccactgtggagaggccccttgggaaaacccaccacccccatttctcctcactccctgcctggacccatggtctctgcttggtctggcctatgctattaaaaatatacttcaatgatgatacttatgtcttgtgtttctctacactctttgtctatttgcagtggacagcacactgcatgctgatatcaaaaattattccagcaaattcaaaaataagacagtaaaaagaaataaaagacagttttacaatggaagagacagaaatgaatagttgcacttatgtttgatttagctgttaaatctaagagaaccaactgcgaatgagtagagaaagcggtcgttgctgcatactgaccattactagtgtgagatactgggggagctaggatggcctcctcttcctcttccttctcttgcctctcctcttctttcttttttggtaaatatctttcctagatcagcggttctcaaaactttcggtctcatgacctaatcacctcccagaggccctacctccaaataccatcacattaggggttaggtttcaacatatgaattttggggggacacgaatatttagtctagaatgctttttcaagaaaaggaggacagaaagatcatactacagtggcttttaaaaattagatatggacagcttttgtttctggaatatgtcagtgtgctgttgtgcaaagcatcccgggaacaacacctcagaatgtttcctttctgtgcctcagtaagacttgaaggctggtagggtagcctgagtcgtggctttcaatgatattcaggtcctaattcctgggacttgtgaatactgcctgtctttgtccgttttgcattgctgtaaaggaataaccgagtctgggttatttataaagaaaagagttttatttggctcagggttctgcagactgtacaagaagcatggtgcccacatctgtttctggtaaggacctcagaaagctttcaatcttggtggaagggggaggaggcatcacatggcaaaaggcagaacaagagggagaggagaggtgccacattcttttaaacaaccagctctctcatgaatgaactcactgatctccacagggagggcaccaagctattcacgagggatttgcccccatgaccccaaaacttcccaccttctttttctttttcttttttttcttttctttttttttttggagtctcgctctgtcacccaggctggagtgcagtggcgtgatctcagctcactgcaagctccaccttcccggttcacgccattctcccacctccctagtagctgggactacaggcacccgccaccacacccggctaattttgtttttgtatttttagtagagacggggtttcaccgtgttagccaggatcattctttttctttttcttaacctctgggagcacagaacataacataggatttggaggggacaaatatccaagctatatcattactttatatgagaaaaggggttttgcagatgtaattaaggatcttgagggagacattatactggattatgcaatgggccctaaatgtagtcacagatgtcctttcgagagggaggcagggggagatttgaggacagaaaaggagacatgaacagcggtgggatgatgcagctacaagccaagcaatgccagcagtatctagcagctggaagagtcaaggaaacagattctcccctgggacctccagaaggaaccagtcctgctgataattttatttcagttctgtaagccttcttttggattttagattctcagaactgcaagaaaataaattgctgttattctaagcccctaagtttttgacaacttgttgtagcaacaatgggaatctgatatagctaaggtaccatacattttgacatcttctctatatatggtaccattctgatttgtactgtgcaaggcttccttgccctctcactggtaaaccttggtatgcaggaaattatttttgtacattctccagtatattaactttggttataggtgatacattatatctattgcaaattatcattttgtctcctaatttgcatcaaccatgctgcttgtgtctatttatgactgattgtgtaggaaaattcttcaagaaaaaatcaaataggatggtaattcctgcatcttggaatgcctaaaaatcttctggcaataactgattacatagagaaaccatctgtttacttccttcaggaactacctggcaccttctagtgctttcccttgtggaccacaggtgatggaggctgggccctaatccagcacacacctccagtctagcgggcttctggtccagttatttacctacaggtattttattgatgttattcttcctctgatgacacgctgatttcaaaacatgcctaaaaccaaagacacaggatctttgaagtcccttccctcaaatatctgaggcttttccccaattgagcagcagttcacatgcttgtaagttttaaatgtgttaggcattttactggaaatgctttatatgcttcacactccacaggacttcttattcccagctcattgattgaggaaagtgaaatctgccatttgctgatgggccaatgtcaaggccaatgtcccagatcccctgtcaggacaaaagtgtgatgcagccagaagtcagccctcacctgcaaatgctctcctgaacttgcctaccctggagggatctgctcaccaggcagattccaggcgatgcccaaagcactccctaataaaactctgtgtgctcatctccgccttaacttctgtttccaggagacccagcttgtgaccattgtttccaggaagattaccaattgtctctgtttgccctggaccgaaggttttcccaggacatagatctttcagtgctaaaacaggacagtcctgagttatcttaggaccaggaatgtctatgaaaggagacacttgagagatgggattctggagccatggagaccccaatatgggggagttggaggtaggggcgcgagggtagatgcgcatatagcccctaccatggtggagcaatgcagtgtgtaaactttttaccagtggtgaatagggatgatttacctataggaggaaatgaaaaagcaggaccatgagtcagacatttgagagacgtgaagaaaacagaacattaaaggaaccaattccacagctttctctgttggaacagtgtggtagtactgatactaagtgtgattgatgatttgcaacagataaaatgctggaatgattaattagcaatgaaaaactagaagatgtggggcaacaaggctccagctccatcctcttagggtaccagctgggctcaagaattgacataaaacagattcgcaggagacaaaacatacaaatttacttaatacaagtttcacatggcacaggagccctcacaaggaaatgaagacccaaagaagcagttagagtcagttacttatataaggaattggtcaaagaatagtcagttgtgaagaaacgactaaaatatgtggggaaaaaagccccagaatctggtgtatccaaataggactccactctgatgacaggtttcttgggctgagattcctttgagccccatccaacttcttcccagctgctgagaagagaaaatcttttagaggcttcctggaattttcccagtccacactgattttgcttaaaagataaaagttattataataaggtctgttcagcagtatctcagttttgacttctcatccctgaggataagaatgttgcttttccttctagcatagggagggacagggtttttcacatgggacttttgtcttctgcttttaagaaacagaaaacagcagaatgatctttttgcaactggtgttttcaagtgccttttacttaaatagtcaatttgctagaccggtacttttttatttcttttcttttttttttattatactttaagttttagggtacatgtgcacaacatgcaggttagttacatatgtatacatgtgccatgttggtgtgctgcacccatcaactcgtcatttaacaccaggtatatctcctaatgctatccctcccccctccccccacaacaggccccagtgtgtgatgttcccccactgtgtccatgtgttctcattgttcaattcccacctatgagtgagaacatgcggtgtttggtttttcgtccttgtgacagtttgctgagaatgatggtttccagcttcatccatgtccctacaaaggacatgaactcatcaatttttatggctgcatagtgttccatggtgtatatgtgccacattttgttaatccatagactggtacatttttaactccatcagagcgcaagccaaaaagcttcctcctgggctgaaaaaaaaagcttccccctgggctgaaaaaaagcttcatcttgggctggaaaagctttttggcttgcactcttcctctgggcctgagccttccctgccctctcatctgcttggacagagggcagggaagactgaagcccagaacttaatcctaagtgtagcagaccatcgggaccctgacagggtaacagtggggtactgagtcacgggacgaggccatctggattcacgcacctgaaaatcttgatgtccttgaattttccaaacctgcagaagtggccctcccttactcattgaaacccatgtctcccttccttttgcctgaagatgatgcagagacctctgacctgtgagattgtatccaccaccacaagtgtccccagaaatctgccaccacctcctattaagaccaaaggaccaataactagaattgagtcccaaagaaacctggcaaggaatgtgatagacctgctgcagaactaaggagctgcagaactaaggagctccagaaccagccaacacgtgcagtgggccccaggcgagtgtgtatggggctggattctgagggtgtaagatcaaagtgcaaaacctaagattggattggggagggtttatctgctggaagcactctcctgggacgcaggctttaaccccctagcaaagacattgaggcattctgcaagcccgccgcaaggattgcccttaggaggacagagaaagcaatggtccgtaccaagcaaggtcataatgccagatgtgctgtggcagatggtgggagaggaatcaaaaggtcctgggaggccaggtgtggtggcttatgcctgtaatcccggcaccttgggaggccactgtgggagaatggcttgaggctaggagatcaagaccagcctgggcaatatagtgagaccctttctgtacaaaagattaaaaaaaattagtcaggcatggtggcacactcctgtagtcccagctactagggagtctgaggtaggaggattgcttcagcctggggagtttaagactgtagccagctgttccagcctgggcgacagagtgagaccctgaaaaaaagaaagaaagagagagaaagagagagagagagaaagaaagagagagatggagagaaagaaaggaaggaaggaaggggaagggaagggaggaagggaaggaaggagagaaagaaaaaagaaaagaaagaaagagagagggagaaagagagaaaggaaggaagggagagagagagggaaagaaggaaagaaaagaaaagaaagaaagagagagagagagagaagggttctgagagtgcttagctggaaaggcaataccaggtactcatggacatctccccaagtgagagaattctcaggagggcctggggactgcagtctgtaattgattgataagcggtgcactggtgagagaaatccagcatccttgagaaactcagtgggtagttctctagaccaggccagcaggggaagctggtaaggaagttgatagcaatacggatggaaggaccatgcagtgatagtgtcacattgtcagggcttaagcataggagccaggtgtgtggcaaaagatgaagtggcagcaaggcacctgacattgaatgatggagtcagtcagtatagcatggcacctctcggggcaagatgcataagccaccaagaaagggacagcttctaatctttttagcttattttttatttttttgttgagatgggggggtctcactaggttatccagagtagtctcgaactcctggcctcaagtgatcctcctgcctcagcctcccaaattgctgggattacaggtatgagccatagcttccggcctagcttttaatctatattttcagagggaagtaaggaagaagggtcaaaccccattaacaagtttctgaaagagcctaacttgcaatgtctagtcattccagagtaggatatttaccccaaggattaattcactgtagttgctgtgataaatgaccaaaccataaactgagtgactaaaaacaaagacctctaaatgattacacctggtatctttggaggagccattcaatctactatacgctgcttccaagtccttgtagaaaaacatacggaaatcatgcatcatcccatgggtggaagacctcgctccaggttagtgaactgctctgatttgtgactccaaagatggacattggtgacagcaaaaggaggacccagaatctcgtgtattcaaacagaactccactctcatgagaggtccttggatctagacccttgggtcaagcttcctctgagcattgtccaacatcttcccacttgctgagaaggaagattctttatgtgggccctggaatagcctcagtccagcctgatctctctctcttccctcctgaagttttatttcaaacattttgagactctaaaagggtttctttgtctcatttctctcctccagtcctactaccagggttgtcttcaatttatatccaatgtttctctggcctggaactgagacctacctcccaagcagcgacccgacccgtggagtggggtccctggggcaagcgaatggtcctttgcctggagaacctgggccagcagtcatggcaggtgacacattccattctggggcgaggaaccagggagggagcactgcatagatcagaagggtaaacaaggggagggagaaggagcaaacttagatttgggagggaaagagggaagggtgcagaggaagcagaacacggatgactgggcctccttcagttgttcttgtgactagaccctcccatctaagccaccaggggacaggaagggtatgagtttgaggactctaatggccccaaggtactactgtggtttatcctacttgtaggcggtcccaagagctttgttctctccagggactcaaaggggatgaacttgcaagtcttttgtctccactcagtgccttctctgattaggccaataaacatccccaggcctcagtctcaggccactgtaggggctgaggacagtgagaaagatgtgtgagcatccaccctttggagaggttgagtaggaatgagaggtcccctgccttgcctttggtccttgtgaaggaagatgttggatatttcccagcttggctggaatccgttcctcaccctccccattcagagcagggatgagtaagtcctccgctttctccgcaaccacaattgtgtttttcaggaaaggataaagtgggaaagatcagatcccatgcctcttcctcctctaagtcatgggatgactgcagagagtgagcaagagggtaaaaacagtgcactgagtgtgatgtttgctaaaggaacagataattgcatcaaaacctatttctagcagagttgtggtgcttgcctataatcccagctactaaggaggctgaggctggaggattgtgaggccgggagctcaagaccagcatgggtagcatagtgagagctcatctctaaaaaacaaaacaaaaaaccacacttatttctaattgtctaattggtatccactatcagacctttctgggaagttttttttctaacatgcctaaatgtggcttggagactgtttgggtgaggccaatagcttagccttcctacttaagttgtctccttcattcattcaacaagcaggtattattgagtggattgttgggtgcatttgtgtgtcctcagtaggatgcaggcatgcaatacatgaagatatgataattccagtcagaggaatggcctgtgcaaaggccctgaggtagagagaaccttgataattgaaagaacagaaagaaatccagtgggactggggaaagagaggaaggagatgagaggggagttacaggcagccaacagatcatgtgcagacagatcacttgaaagcagaggcaaatggctggatgtttttgttaatgaaaagagaatttatttgaagatcttccatcatttttacatgaagtgattgatgtgttaaatgaatgaaatttaacattcatggtgtatgaaatttatggaagaaaaactgaagcaggcagagcattttatggcctttgggcacaagagagtgaagcttgtcccatgtagagtcatggagagtgactgggagattcaccattagagttggcagattggctcttggattgaatatggggcatgaagcaaagagttgttgactcctggaagtttgactttgtcaatggcgtggctactactttcttttattaagagagagacagatgggagagcaacaggtttgagggaaacacataaagtgctttgtttggactcatggggattttttggagaagacagacaagatacaagtaacaagatgatgatgtctgtaatatttgggtacaaaatgcaattcataaacctgattgtataatatgatcctatttatgtaaaatcatatatatttagttaccttgattcaatttatacatcactaattgtttccagtaatattaaccaaaggtctactatatgccaaataaccttttatggctagagatagaaaaatgaacaaaacttactatgttcatccttatggaagatacataattcatatttgtaaacatcacatttaagtatggcaagaaatctggtgggatggttcctaaaatgaaacaatagtttcataggtttgtgagaatttaggtgatatttctacttaactttcatgtacactaaaaatttttcctataactcaaaaaaattttttggaggcagattagcaagatatttattttggaaaagcaagagtcaatctgaattgaactggagggatgctgagagttctagaacttcatagagagaaagaaaactgagttattgggtgggggttacacctatctttttgtcttttcttttctttctttcttttttttgagacagggtctccctctctcactcaggctgaagtgcagtggtatgatcttggctcactgcaacctctgcctccctagtagctgggaccaccacaggcatgcaccaccatgtccggctaatttttaaaatttttttggtagagacagagttttgccatgttgcccaggctggtctcagactcctggactcaagagatccgcccaccttggcctcccaaagtgctgggattacaggcgtgaaccactgcgttgggccgcttatcactttaatgtctaatgagaggcccctggagctggaacccttagccccagcctgacccctgacccttctcccatgtcctcaaattcaaaaactcacctctggctgtccattcagttgttctcaagtctgactgtgctctttgtccttcatgaactagaactagtctttctttcaaaccattttgatgagctgatcaatgtctcctcataccatttttctcattcagccttcctcctggggttggttttatttaccatctaacaatatttctgtaaccctgagcctctagagctgcctcaggtgcactaacgctgtgactaggctgccctgggacaagctaagaggttctgcgggggagggtctgggcccctggtgtggcagaaggtgcatccatcctggaggaagccagaggaccaagggccaggagcctgggggggattagaagggaccaggaggcctggtcctgagctgggatgggaaggaacgggaaggggcaggagcaggacagggatttccagatccactcagccgcctccctggggcttgggctcctccatctgaggccaccagggggcggcaagggcttggatttggggaagggaattgctgtggtttaaccagggagtgtatgaagctccatgggctgcttcctcctgagacccttctaagggagaagtggggagtggaatgtccaaaatatgttgtgtcccaatatgttcgtttctagaaaggctaataaatagcctcagcccccagcctcagagcactgcatagaaagaggacagaggtatttgagggtcattctgagagaacctagaaggtattgagtgggaataaacagtccccagctctgcctttggtccctgggaaacagagtgcctggatcactccacagtggtcatctgggatctggtccgaggtctcttccttgattctgttccctgagccttttttattctattttggatcagatccatgcacacgtagctcagagttgtgcccaagatttcataaggaatttacagggttttttccccctcaaacttatttctctccacagtctgcccattatttatggttccccagactttcccttttggtcttctggtgaaaaaactgtgactttaataagcctgcggtgctgtgcacttcctgcaactgagtccgtgtccacaccaaacaccaagaggacaaagagtaacaaaggtaaggggattaagtgccactgtcttggaaatcagctccaaagatgagaaaagaaagtccgcacagtctctactgtccctgctgtcaccacgaagaatttcctggaggctggatcatgtagaatggagagaagaacaaacataagaaaaggaaaacgtggacatttcaaatttgccctgagcactaggggtttcctttctcatcttcaagccagaacagtggagcttcttctggaacttttgtggctgcacactggtaccccttccaggtattggtctgccctgagtgcaggccacaggacactgggggaaaatgggaagctctctgctggtttgattttactaaaagtgctagtatctcccctagtctgcctccagtgatttgcttttccaagtaatcaaattgatgctccatggattctgtcccaggttttacagctgggcttggagaaaatgtggtatatgccactgcatccgaaatggaacctgaaaacagtaataatattctaaacgtgaaaattaaatcaatctgaatcacaggcagtggaaaacatcaaaagatgaaagagttttaaaagtgatttgaggaaagaaacagggagaaatattttcacattggttctatgtttactctatttatcttttttaatttaattttaaaaatagagatgaggaggtctcactatgttgcccagccaggctggtctcgaactcctgggctcaagcaattcacccgcctcagcctcccaaggtgatggattacaggcatgagccaccacacccggcccctgtgtttcttatgtgctccttgattaagaagagttgttttttgtttttgtttttgttttttgttttcttgagatggagtttcacttttgttgcccaggctggagtgcaatggtgcaatctcggctcactacaacctctgcctcccaggttcaagcgattctcctgcctcagcctcccaagtagctggattacaggcgtgcaccactacaccagctaattttttgtattcagtagagacggggtttcaccatcttggtcaggctggtctgaaactcttgacttcaggtgatccacctacctcggcctcccaaagtgctgtgattacaggggtgagccaccatgcccggccaaaaagttggtttattgtagcttgtggatacagtgagatggaagaaaacccagaaagcagaaataacacttctttgtaatatgaggaaaaaaataaaagataaagttgaatgaaatatttcatatatatatgtttcatatacatgtttcttatatatgtttcatatacatgtttcatatatatgtttcatatacatttcatatatatgtttcatatacatttcatatatatgtttcatatacatttcatatatatgtttcatatacatttcatatatatgtttcatatatatattgcaacatatatatgcaatattcatatatatagccatatatatgtttcatatatatattgcatatatatgtttcatatatgtttcatacatatgtttcatatatatatagttttttacagagtcttgctctcttgctctgtcacccaggctggagtgcagtggcctaatcttggctcactgcaacctctgcctcccgggttccagtgattctcctgcctcagtctcccgagtagctgggattacaggaacgcaccaccatgcctggctaatttttgtatttttagtaaaagtggagttttgccatgttggccagtctggtcttgaactcctgccctcaagcgatcctcctgcctcagtgtcccaaactgctgggataacaggcgtgagctatcacgctcggtctgaaatctttagataagtatgaagtctatataaaaaaaaaaggctcttactaggctagaaatggcccattttagaagctttcattttccacctcacactcatctctctatagatcctctgcttgggcagtgggtggaccttgtggtcctcagttctcaggctgagaaccagaggctgaaaaggacaagtcacctgctcatgagtgggaagggcaggattgggagcagcggactgtggctccattgctccttgtttcctccacaggcccctcccacgtgtgcccctgaatgacctagaatgactaatgtgctcaagggatttgatgctgcagatgcttcggcatgaagggtgggggtggggatgggacaaggctgcagctgaagagatgggagaccaacaacacacagcaggggtttccatggggtgggcacccccatttcctcacagtttagagagcctggaggtgggtgccaagcagagggcaccatggcgtggcccaggcctggaggttcacagagacacaggcacaacacagcagagacactgagggccaggagctcactcagatgagggacttcagcagatctttctctcttgaggaaattaggtacaaaggaatcaagttcctaccatcagaatagacaacaagttttaatctcctcagctgagccccgctgtcgagggaagcagaagtctctgagcccggcccaggtgagagtggggtgaggagaggagctcagggtgcagatttgcatgaaggccccaccctcctctgaggcagaggggataagacaagtctgggggtaggcccagcgctggggtctcaggaggcagcgctctctcgggacgtctccaccatggcctgggctctgctccttctcaccctcctcactcagggcacaggtgacgcctccagggaaggggccttggggacctctgggctgatctttggtctcctgctcctcagactcacctgggcccagcactgactcaccagagtgtatttctccctctttccagggtcctgggcccagtctgttctgactcagcctcgctcagtgtccaggtctcctggacagtaggttactatcttctgcactggaaccagcagtgacattgggggttatgaccttgtctcctggtgccagtagcacccaggcaaagcccccaaactcatgatttatgatgtcgctaattggccctcaggggcccctggttgcttctctggctccaagtctggcaacacggcctccctgaccatctctgggctccaggctgaggacgaggctgattattactgcagctcatatgcaggcagctacaatttccacagtggtccaagttcatgcgtaatgagaccaaaacctgccctggtctctcaggctctctctcgctatgaaggtgcttccttaccctgtgcagaagagggtttcatgcaacatggccttgagaatttcatccactctcagcccctctcccctccaacaatgaaatgcaaaagaaacatgctctctggttaattgtctagggacaatggcagcttcttcttttcctgtgtgatatggtcctgcatggtgactctttccaacttttcaatggcagggacagagcaataggatccatctgctcagtaccatttctgcagttttctatgaaaccctcacattaaatgcctccatctcccacactgtgctgactggcctgggtctgtgctccagaaataacgtcttactcaactccatatccaccacgctgtagtaaggatggctgtctttgctgggttatttgttcctctgcaggtctcttcccaaagcaacaccaactgagagaagatctgaagatgttgagagagtgagcataaaagtaaagggttttatttatttgctttcttttttttttaactttgtttttatttatttttttgatacagagttttgctcttgttgcccaggctggagtgcaatggtgcaatctcagctcactgcaccctctgcctcccgggttcaagcgattctcctgcctcagcctcctgagtagctgggactacaggcacgcgccaccatgcccagctaatgtagagatggggtttcaccatgttggcctggctggtcttgaactcctggcctcaggtgatctgcccacctcagcctcccgaagtgctggcattacagacatgagctaccatgcctggccttgtttttattttttagagttcctttgtctttgacccgatgtctatctatgggggcttagccagggcacatttgagtgattgttctttgcgagaacattgttctttgcagatcattaaacccctgtcctggaaacagtcctgtacttagactgtctccctgttagcatgggctctttcctaaatgatccacaggaaagcttatttggtggatgggtcttctgttcctcaaggactctatgggtagtttattttcaaggtgagccaatactgtttctagctggaatctcatttaatctcataaccatgagaattaattttttaaacctgcagggtgttctctagccattttttaattttctttgattttgtgagccacttttaaattataatcatcattaaaccttaaaacatataaacttcaattaagcagattatatattttattttattttttgagacagagtctcggtctgttgcccaggctggagtgcagtggcacaatcttggctcgctgcaaactctgactcccgggttcaagtgattttcgtgcctcagcctcccgagtagctggaattacaggcatgtgccatcacgcctagctaatttttgcatttttagtagagacggggtttcaccgtgttggccaggctggtctcgaacttctgacctcgtgatccacccgcctcggtctcccgaagtgctgggattacaggcatgagccatcaagaccagccacatatttttaaaaagtacattggttattatccacatacctttggactgctataacacaataccttaaactggtggcttataaaaacagaaatgtatttcttacactcgtggaggctgggaagtcttaagatcaatgtgctggcagatttggtgtctaatgactgtctgcttcctcatagaggccattttctcactgtgtccttggaactgaggacaaagcagctcctggtaaagttcagatgtctgtttcttgcaggaaaatttctctttacagtgatctgggctactggctccaacacacgcacccagatggatttctgagccggtcattgaccattaccattttaatattatctcaaattataaacattatctcaactattgtttaatataatatagcacataaatgtttaaagcatacatagcgaaacaagggtcttacattcaaaactgtcatttccccaatcacccatctccttgtccaccaagccccagtgccaccacttagctcattgctcctttggcttcactttctggtgctcttgcaagtgtctgtcatgtgttacaaacaacaacaaatagtcctccaagaacgtttacctccatagaatccctatcctgtttcctgagtggacatttccatttttaatctggcaaagatcagtcagccctgattagtgttttaaactcatatccatctctttctagaaaaacacactaggttaagcatctctctgtggatgggggaccctcatgaaggcacacagctctgagctgaggtggcctcaatgtgtacaatggagcaagacaaagaaaagtcccatgttctgtgtgatagacagacaggcactgatgagaggtctccagagctggcgcccttagtctaatcttgactctagtcctcgtctttccgacccttaaacactagaattcctggtctgcattccattaggtcattcttaaatctagtgagctgtatctccttcatgcaatgtttttctttcactattattttcagctttattgacatataattgacaaataaaaattctatatatttatggtatacaacttgatatattaatacatttgttgtacattgatatatttgttgtgaaattactgcaataattgtgtgaaatcacaatcaatctaattcacataaaataaccttacataattatcatcttctttcttttttttttttttttggtgagaacacttacaatctaccaaattagcaaatttaaagtaaataatgcaatattgttaaccatagtcacattgcggtacattagctatctagaacttattcatcttgtatcactgtactcttttataccctttgataaacatctccccatttcccttttccctccccagtcctgacacccaccattttactctctggttctatgagtttgaatattttagattctacatgcaaataagatcatgcagtatttgcctttctgtttctggcttatatcagttaacataatgtcctccagctttatccatgttgttgcaaatgatgggatttcctttattttttaaaacttggcaatatttgtgtgtgtgtatgtgtgtgtatgtatgtatgtatgtgtgtgcatgcaccacattttctttatccattcatttgtcatcagaaatttaggttgtttccatgtgttggctattgtgaataatgttgcaaaagacatgggagaacagatatctattcaagattctgatttcattttgttttgagatatgcccagaattggtattgctggattatatggtagttctatttttaattttttaaggaatccccatacattttctacaatggctgtttagtttacattcctttcaacagtgtacaagagtttcttttgtccacatccttgccaacatttgttatcgtttatctttttgataaattacaggcacgtgccaacacacctggctaattttttatatttttggtagagacggggtttcaccatgttggccaggctggtttagaactcctgacctcaagtgatccactgcctcggcctctcaaagtgccgggattacaggtgtgagccaccatgcctggcctattttttctatttctataaagaatgacatttgtgtattgataggtctagcattgaatctggagatcactttaggtagtatgaacatttaagaatattagttcttccaatttataaacacgagatgtcttgatatttatctgtatcttctttaacattcttcatcactgttttataatttccagtgtaaaactctttcacctccttcgttaagtttattcctaagtactaattccttttgtaaatgtgattgctttcttaattttattttcatatatttactgtctgtgtgtagaaacgtcatcaatttttgtatgttgatttttttatccttcaaatttacttaatttagttttaacagactttttgttattgtggagtctttaggtttttctacacttatgtttatgtcatctgcacacaaagattaggattttaatccttcttttccaatttggatgcgtttcatttctttttcttgtcgaatttctctggttagggattccagtgcaatgttgaattaaaataagtggagagggggcatcttgccttgtgtgggatcttaggggaaaagcttctgtttttttcccattgattatgatgttagttgtgggcttttcacatatggtttttattgtgttgtggtaagtttcttctgtacctatttcattttatttttgtttttttaaatatttattttataatagagattaattttgctatgttgcccaggctggtcttgaactcttgggctcaagcgatcctcctgccttagcctctcaaaatactgggactacaggcatgagccactgtgcccggcctatcactattttgttgagagttcttttcttttcttttccttttttttccattgctttcttttcttttcctttccttttttcctttccttccttttcttttcctttcttttctcctcctcctcctcttcctcttcttttttctttcctcctcctcctccttcttcatcttcatttaaaatcatgaatggatgttgaatttggccacatgccttttgtacatctgtggacataatcatatgtgtgtgtgtgtgtgtgtgtgaatctttcagcctgtggatgcgctataccatccttgcacatgcggaatcatccttttatccagggataaaccccacctgttcctgatgtatgatcttcttaacatactgttgaatttggtttgctagtattttactgagaatttttgcatttaatatctgttaatgtttatcagaggtagactggcttgcagttttttttcttttctggtgttgtctttgctttgttttggtatcagggtgatcccgacctcataaaacaattttggaagtgttcccttttctattttttggaagactttaagaagaattaatattaactcatctttgaatgtttggtagaacattcagctatgaagccatctggtcctgggcttttctttgttgagatatttttgattattgagtcaatctccttctttgttattggtatgttcaggctttgtattttttattgatttgcttttttttttaagttgactgtttctaggaatttatttatgtcttttaatttatctagcttggtgtataatttttcaaaatagtcccttatgatcctatttatttatttgagacagggtctttctctgtcacccaggctagagtggagaggcttgaccacagctcactgcagccacaacctcccaggctcaagtaatcctcccacctcagctttctgagtagctgggactacaggcatgcaccaccatgcctggataatttctttttctttctttctttcctttctttcctttctttcctttctttcctttctttcctttctttcctttctttcctttctttcctttctttcctttcctttctttctttctttctttctttctttctttctttctttctttctttctttctttctttctttctttctttctttctttctttctttctttctttctttctttctttcttttcttcttttttttgtatagatgtgacctcactgtgttgcccaggctggtcttgaattcctgggctccagagatccacctgcctcggtctcccaagtgttgggattacaggtgtgagcctttttatttctgagaaatctgttgtaatagctccttttttcattttggattttatttgagtcttctctcttttttcacagtgtagctaaggatttgtcaacttcgtttaatttttcagaaaaccatctcttagttttgtttttttctattatctgtttgatttatttctgctgtaatctttattatttcatttttttctgctaagtttgggcttagtttgttcctctttttctagttcgttgagttataattttaggttgcttatttgagatctttcttcttttttaatgtttgcttatctccataaacttcccacttagcactgcttttactgcatcctataggtttggtgtgctgtgttttaattttcatttgaagatatttttaaaattccctttggttttcctctttgacccaatgcttgttcaacatgtgatgtttgatttctgcctatttgtgaatttttccatttttttttactgttattaatttccagattcatttcttgttgtaaaaaaagatttttggaatgatttaattctccttacatttcttaagacttgttttgtgaccaaacatgagctctctcctggagaatataccctgtgcatgtaagaagacattttgagaacccaggtggtcttttctcataccatttttctcacccagtgctcatactgaggttagttcattttacatctaacattttctcagcctggagctaagacacctcatgtacctttgacaaagccattctagcacaagcaaaacggtcctgagaacgagtatcttagccacctggtatggcagaggacacattcatcatggaaaaagtctgaggaaaagggtcaagattagcatggatcgagggtctggtcctgagctgggaggagaaaaaggcaggttggagtgggaccaaaccaggtatttctatctctcacttagaattgtgtcttggtacttgagatgaaccatctgaggccaccagggggcagcaggggactaggttggagaagatgattgataaagtttatcctgacctttaagaagcccctgagtcggccgggcgcggtggctcacacctgtaatcccagcactttgggagactgaggagggtggatcataaggtcagaagatcgagaccatcctggccaacgtggtgaaaccccgtctctactaaaaatacaaaaattagctgggcgtggtggcttatgcctgtaatctcagctagtcgcgaacctgaggcaggagaactgcttgaaccagggagttggaggttgcagtgagccgagatggcgccaccgtgttccagcctggtgacagcgcgagactccatctcaaaaaaaaaaaagtccctgaatctcaaaaaaaagaatgtgactttatgattaactatgaacagctgctcattaataaaaagccattaaaaaaaaaaaagaaatcccaagagctacttacccttgaatatctctaaaggtactgggaagcagtgctccaaatctgttgtggcccagtgaattcctttttagaagcaccattaatggtcctagttcaacatgtcaggccccagctttaaaccactgcaggggcaggggatgtagcagtgcttagaacccaccttagctgagaggaccaagatggttgggcaggggatgagggaaatgagaagttccagcactgtctgaagtctctgggaggaggagtgattgaactttcccacccggcctgggagcagcctgtcctcacattcatccctcacagcacaaaggagaagtcctggtttcctcagcctggagctcctgcaatagtgagggttaggatatctctggactggcctgatgtcctgggcactctcatgggttcagtctcaggaaatccatgcctaggctggattaataccctcagctgagcctcacagggaagcagaagtctctgagcccaggcccaggtgagggtggggtgaggagaggagctcaggacacagatttgcatggaggccctgccctcctctgaggcggggggataagacagggctagaggcaggcccggtgctggggtctcaaggcagcgctctcgggacatctccaccatggcctgggctctgctcctcctcaccctcctcactcagggcacaggtgacacctccagggaaatggccttggggacctctgagctaatgcttggtcttctgctcctgctcctcagggtcactggacccagtactgacccagtagagtgtgtttctccctctttccagggtcctgggcccaatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttccatagtggtccaagttcctagggaactgagaccaaaacctgccctgggctctcaggctctgtctttgctctgaagatgcttcctcaccctgtgccaggggcttcctgcaacagggccttgagaattcacttctctgtcagctcctctccttttccatcaattcccaaaggaaacctcctctcttgtttactctccgggatatgacagcttcttcttcactcgtatgacggatgtcctctctgaattggaaactacttctagctctttaacaggaagtacataccggcagggaaatgcctgcctagtgcagtccccatacttctccggatgatcctcactttattatttatttttatttttgtatgcactaaagtcgtcaatgtaaatccttacgtcgaatgcctccacttcccacattgtgtagcacagcctggattcagttcttcagaaatgacgtcctcttcaatgataaaggaccactgctctgtgaacaccccactctagtgaagatagcccaccttgctgggttattcatgtacatcttttgtggaagcagtaaccactgtgtaaagctccaaagatgttttaaagcaatgaaaacaaagaggaagaagtgtgtgtgtgtgtgtgtgtgtgtgtgtgtgtgtgtgtgtgtgtagggtccatcctgtttgccctaatatctcaggttgccgagctagggagtatttgagtgacagacttggtgccctctcaggatcctcctcctctcacatcactgagtccctgtcctggaaacaccctacaggtggacaatctccccatagtatggaagtttccaaaatggctccacagggaagagttgagctgaacacacccactctttctcatgggcatcaaatatatctaatttttctggggaaatcatcaatttctagctggaatcctgattaatcgacagactgtgagaattaaaaattttaaaaatattcagacatatccagagtccagtatttaaattctctggaattttgtgagccaatctttaaacatagttattattgtagtttagagttcatgaacctgaattaaatagattctagtaaacataaagtgccttagttgtctattgttgcataaaaattactcctaaaattaacatattcttaatgagaacacatatgcattaatctgttttcgcactgctataaagaaataccttatttataaaagaaagaggtttaactggctcacagttccacatggctggggaggcctcaggaaacttacaatcatggtagaaggcaaaggagaagcaagaactttgttcacaaggtggcaggtgagaagagctggggagggtgaacttccaaatacttttttttttgagatggagtctcactctgttgcccaggctagagtgcagtggcgtgctctcggctcactgcagcttctgcctcccaggttcaagtgatcctcctacctcagtctccgagtagctgttattacaggcatgcgtcaccaagaccgactaatttttatatttttagtagagatggggttttaccatgttgaccaggctggtctcgaactcctgacctcaagtgatttgcacacctaggcctcccaaggtgctgggattacaggcgcaagccattgtgcctggccccagacacttttaaaaccatcagctctcatggtaactccctacccatcacgagaacagcaaggggaaaactgcccccatgatccaatcccttccgtccctcaacatatggggattacaagtccctccttcaacacatggggattacaatttgagaagagatttgggtggagacacagagccaaaccatattaatgtatttgtgatcttgtagttttcttgcatcaagaatctgagagctgcttagtttggtggttctgactctgggctcctcatgaaattgcagccaagctgtcaggcggggctgcattcagaggccagagcaggtggccaggcccagcctgagggggcttctactgtccctaacctctttggcagatgtagatgaagtcagggaaaaggggagctccccacagtgggtagcatcccagtgtcagagggaaggcaccatggagcagtgggaccagcacaggaccctgggggtgcactcagacctacctggagggatggcaagaaggggcattcacagcagggacaggataaagggcctctgccccatgtccagagctgtcttggcagctcagtcacattggttatcaggtaaatcggaggtaaaccctatcctgagttttaccactgaaaatgggtacaatttgaactaggagtgttttcagactttttctttccatattgacttcttaataaccgcgatttaattttttttaaccccagcctagtttagctacatagcttccaaatgtcatgctactgtgaaactgagcaattagttacttttatcagagcattttaaatttgaacaggttccttggtctttctatgtgtaattagtcaaagcttaggtatggagtagaggatctttaccaaatgcttttctagactctgttttcattggacttatagcagctgtttcacctgggccatgcaggaataggagagttgttgctccttgacatagcatctgtaacatgcctatcctttctgccactataaaaatagctgtgctttctctccactcgtctctcctgctgtttccctgtttttcctattaaatatgcagtgtttgcaatccatcttgcattctgagaagatgaggattttttttcataaagaatgacctaaaatagctctaaagatcatcagaagtcacaactacatacttactggagtgcaataccaaatgtggcctctgattacagtaacctggagcttgcagtttaagcaattcagtccctgtcacttgtggacagattcgtatgtctgtggatgagaagatgagcaacggtcactcctgtgctcatgcacagatccctccctgcccctgtcctcaaattcagactgaagtgcatggccctggagcattacatgagtgatggtttaagagcacgttggtgatacacacaatattaatggtatcttaatttgcttgttaagcataatttgaaaacatctggacaaatttggacacaatttgaagggcatatttgataatagcttgtgacaaatgattccgttctgggagagatgctatttttggttctctaaatcgccatgaaatgaaaatctcagattataaagaaatagactcaaatcccaagtgtcttttgcttttcattccccatcaactgtgttgcccaagcaccatgtggacactgcttacagggtaggcagccaccagctgaaggcaggttctttagttgtctgagctgtcctggagctgggaacagcagcgtgtgttctgtgcctgttggtccctatgtagcacacacccactgcatattctcgctgactcaccaggagggcttgcagcagccctggcctattttcttctgaagcacctgccaatggtgcattctcccctggtcataatgcaccaggagataaacatggcatttgacacacaggtgctaactggatctaggacttctaagcttaagtagactcagagtgggcaatctaaaaaaaaaaaaaaaaataggttctcaatcggtagcccaggctggagtgcagtggctccatctcctacctcagcctcctgagttgctgggacaacaggtgtgtgccaccatgcccagccaacagagagggcaatatggacttgaaatggacaatttccattacttgaaagtttttgagaaagaactgaggtttgtttaagaggaaatcagccagagactcaaagttaaatctatcaggcccaaagtctctttggggaaaggagactcttggacgtgcacgcagcagcaagtggtatgggatcccttctctgtggggaccttggcccaactgccaatcttttcaactgacccatttgcgttttccataagtgctcgccagccagcagctgtgactgcccctcagtctcaggaagggagaaagaaggaaacaggagcaaagcctctttcaatcttagcaaataaagtgggagctttgacttttttgaacacccagatgacaggaaagaggaggaaaattttcctaaagctgttattttttaatgcctcaggaagaatcacacccggagtctcatccacactttatttggaggtatttgggtctcagagtttgtgctgagttagttaatgatttgggctactgggatggggtgaatgtgttttacaagtgagaaagaaataagctttggagtccacagggtggaggcttattggctaaattgtgtccctcaagattcatgcaatgaagccttaatcacagtgtgtgactaaatttggagacagggtctttatggaggtgattaagtgaaaatgaggtcatgagggtgggttcttatccagtctgactggtgttctccttagaagagaaaatttgcacacacagaaatcagacaccagagatgagcaggcggaggaaagaccatgtgaggtcacagcaaggaggtaacgacctgcaagccaaggagagaggcctcagggaaaatcagtcctaccaacactttcaccctggactttccagcttcagcactgagaaaataagttttgctgttgaggccactagttctttggtatcttgtgatggcagcactggcaaatgaaaacaagagggaccccaaagaccttgggtagggggaacagatggagcagggtgcaggaggcagggcagggaggggctggaaggtcatgctctgaggttcgtttcctggatggaactgggactccactcactactgtctggggaacttggggaaaaaacttcacctcccaatattgattccctaataaaatctgggccctgagcatagggctcctcatcttcctactccatatgatgcaagttttcttgaagttatgcttgtaaaacactcaccaatgcatctggcatatattaagggctcaaaagtaggccaggcatggtggcttatgcctgtaatcccaatactttgggaggccgaggtgggggatcactggagtccaggagttccagaccagccaggccaacatggtgaaactccatctctactaaaaatacaaaaaaaaaaaaaaatagctaggcatggtggtgcccttctgtaatctcagctattcaggaggctgaggcaggggaatagcttgagcctgagaggcggaggttgcggtgagcccagatggtgccattgcactccagcctagatgatagagtgagactccatcacaaaaaggaaaaaaaaaaggttgtcattctgcagcccagatcgtgccattgcactccagcctggacgatagagtgagactccaccacacacacacacaaacgcacacacacacaaaaactaacccccgccccgcaaaaatcgaaggtagccattctgctgtatgatctattgatacatacaggatgacatttgtcctgtgggcaccagggggcactgtgacccctggtttgggacactaatggctccaagtccctggtagtacttgagtcatttcctttctggccccttctattgagtggaatcctgaaacccacctgactcttctactcttgaaaaattacgcagagaatgtcctcagacatagggtcagacaagaacttcgacatacattttaaagaatggagagcagatttacatccgctgcttaacagggaaccaactaacaaagaattaagaataaaggaagtagagttgcatgaagagactcccctttctatgataagaaaggcctgaaggtcccttcccagctgtggactcagaggcagagctctggggcatttccattatggcctggacccctcccctgctcgtcctcactctctgcacaggtgctgcctcccagggctcagcccccagtgggatcaagatcagcctggccctgaccttcaactcaacatagggagtgatgcagggtgtggggttctgggaatgaggccctcatcctcagactcacctctcctgtcctctcttgtgggctccgttatttcctctgggccaactcaggtgcctgcagtgtctgtggccttgggacaaatggccaggatcacctgccagggagacagcatggaaggctcttatgaacactggtaccagcagaagccaggccaggcccccgtgctggtcatctatgatagcagtgaccggccctcaaggatccctgagcgattctctggctccaaatcaggcaacacaaccaccctgaccatcactggggcccaggctgaggatgaggctgattattactatcagttgatagacaaccatgctactcaactcacagtgacacaggcagatggaaaagtgagacacaaaccctttttctgtctgtgtcactcacttcctccggccccagcaggactgtggacacagccatgggcaggtctggctcagttttcctggatctgagaccccagggtgccctgacctccaagccctccagggagactctgaagagagtgggttaggtcaggagaggacttggggctggcaggaccagactgtcctggtattgtccagagtggctgtgtcttggcttaagatgacctgagtgtaaggatagtcagagggagacagccattgagtggtaatggtccctggatttccttctgtatggtgactggacctaaggcagtgctgcttttctgtggcccaaatgccccagatcattctgaacttctcaggtttaactgagaccctcaagccccagctccatgacatcctcatattctgaacagggagggccaccacaatgggcagtgtggtgtccatcaagattcccctttcagggctcacccatccgccatacacccaaagctgccgggaggccctggcttctcacagctgctccccaccggaaaatgccattgattgcaaagaatggcctcccccaaaagtttgcccatgtcagagcgtggctcaggtgcaatgactgcttgatgcctcaatcccaaagtcaggccttaatttaggatggccttgaagtgtgttgcagctgagcactcaattgtaacacattcccactcatgcctcccatacttctttcctgagaatatatccctaaacctcactgcatggaattccccctctcagagtaggagtctggggaattaaaagatttaaaaacaaaccaaaacagtccaaagggaagagtaacaaagaggagagagttgcacagagagaggactctggagtctgcaaatgttcgtgagcaccgatgagcacatatgtgggaggaaacaacctctggaagagaaaagaaccatccaaagacacttgagagaacactccagagcgtgtgtgcacgcacacacacacacactcacaccccacataaagaaaacaacaacactcatcatcatcaaattgctaaaaaacattttagcaattttatgctaaaatgatgatgaagaaatgtggtgaagaaatgtagccttaaaagtagccagagagacgaggtggctcacgcctgtaatccaagcactttgggaggtcgaggcaggtggatcacctgaggtcaggagtttgagaccaggctggccaacatgatgaaaccccgtctgtactaaaaatacaaaaaagttagccggatgtggtggcaagcgtctataatcccagctactcgggaggctgaggcagggagaattgcttgaacctgagaggttgcagtgagctgagatcgcaccactgcattccagcctgggcaacagagcaagactcaatctcaaaaaaaaaaaaaaaaaaaaagtcagaggcaaaagacatgttagatacaggtgaacacaatgacaagagcagaatttttattagaagcaatgcaagcaggaagtagtggagctatatttataaaatatgaaaagaaaaaacttataacccagagcaatctacagcctcactgaaatccctaccaaaataccaatgacatacctcacagaaatagaagaaaaaccccacaattctacaatttgtatggagccacaaaagacccagtatagccaaaatgacactgagcaaaaaacaaaactggaggcatcacattacctaattcaaaatatgctacaaacggccgggcgcggtggctcacgcctgtaatcccagcactttgggaggctgaggcgggcggatcacgaggtcaggagatcgagaccatcttggctaacacggtgaaaccccatctctactaaaaatacaaaaaattagttgggcgtggtggcgggctcctgtggtcccagttactctggaggctgaggcagaagaacggcgtgaacccgggaggcggagctggcagcgagccaagatcgcgccactgcactccagcctgggtgagagagcaagactccgtctcgaagaaaaaataaataaataaaataataggccatatgtgatggctcacacctgtaatcccagcagttaggaggccaaggtgggaggattgcttgagcacaggagtttgagaccaccttgggcaatataatgaaaccctcatctccacaaatttttttttttaaattagccagccttggtggagtgagcctgtggtcccagttacttgggaggctgaagtgggaggatcacttgagcccaggaggtggaggttgcagtgagtcatgatcttaccactgcactctagcctgggcaacagagaaagacactgcttcaaaagcaagcaaacaaccaaaaaatcaagtaatatcattgaaaagggggcaaaggatcagaatagacttttctcaaaagaagataaacaggtggccaacaagcatatgaaaaaatgctcaacgtcactaatcatcaggtgaatgcaaatcaaagccacaacgagacatcatcttaccccagctggaaaggctatcattaaaaagacaaaaaaataacaagtgctggtgaagatgcagacaaaacagaagacaaaaaccacgtgatcatctcaacagtcacatcaaatgttttcatgtagggaaacattactgtttgtgattttccagacttgctagagcatcataaaaagtaagatttgtggtgccgatattggagggggtgttattctgtgcaaaaaacctggatatcccatatccaactgtgaagatacttactgataaatgctaaaaaattgcaatattgtgtgtccaaatgttctgggggtcaggagtggggtctcacacgggaaaggattcagtcaaagagaaaaatagagaggctagaacatagaggaaaacataatatgtctggaaataaggagtccaaactaattggagctgagtgataacaaaagaacaatggcatgaaccatctatttctctctggaaatctcattgatatattgtgctctctccagggctatgcccagctagattataaaattgtctgttcctgaaacgtttcttgcgtatatgacagggcctaacactggaatcaagctcaggttgatgagggcagggcagttaagcacccgaccctggtggcctgtgaaatacttgggggagacaggggtttgttgtctaaagcagaggaagtgagattttccactgtggcttagaccagagcttctgaaattccagtgagcaaacaaatcccctgtggagtctgtttaagatgcagatgcagcctcagcaggtctgcgtggggccccagagtctctatgtccagcagctcccaggtgaggctcatgctgcttgtcctccaagaaccacactttgagtggcttaactcctattcgccctcctcactcaagcacaggtgagactctgccaaggaaggcactgtctgagaagcaaaggtgaccttctgtccttcctcccctggtgttttagtccatgttctattgccataaaggaatatctgaggcagagaaatttataaattttaagaaagatttctttggctgaagcttctgatggccggaagttcaagagtgggcatctgcatctgttgagggcctcaggttgcttccactcatggcagaagatgaaggggagccagtgcgtacagagaccaatgggagagaggaagcaagtcttttcctaacaagaatgcagggatgtaatttaatcatatttataaagtgtttgacatagagcctgacacacccaggtactcctagttggcagcaattattactgtcgtcgcacatgaaaattggacctgggatggaggaaaggcagcgcaaaccctctgtttgggacaagagagacttaaataatttaaaattgaggcataggagataaggagagtatccctgggtgttctcctgccaattctctcagcatctcggaaactgtttcaaggtgatgaagtcaaccagagagggaagcggaggagtttgtagaaccaagggttgcaacttcatccatgaggaggaggtgtagtcaggggattgggaagaggtggctgagctcatctgaagggtgtctaaggttttctggcccccatgtcctggcccatccctccctgcccagggtctcacccctcacctgacagcccagagctggagagtggcctatgattctgattagagaccccaccaaagcccagaggggaagacatgggtgggaggcgtcacagaagacagttttctgcctgtggtgttggggcagtttcctggaaaggaaattcagacactgtaggggagaagaaaacacaggagaggaaggcccctccccaggggattgtggcgttagagaccaaagcatcttcaagaagcccagccctgcaggaggttccctgagcccagagttcctagagctgtctgtattattttgcctggggtgccataaaaagtaacacagactacatgactcaaagaacagaaatttattgtctcactaatcttatggcgatggtagaatctgagatcaaggtgttggcagggttggctccttctgaggctgagggagggtctgtttcatgcctctcccctggcttttggtggtgtagcagtattagctgttccctggcttataggtgaatcaccccaatctctgcctccatgttcatatgacgttttctctctgttcatgtcggtgtccaagttttttctttttataaaaagaccagtcctattggatttggggctcactctattccagtatgacccgatgttaactaatcacatctgcaaccacccttttcctatgtaagttcccattctgaggtcctgatggatagcacttcaccatatgaattccagggggcacaaaattcaaattcccaacaatgggccaggcacggtggctctttgggaggatcccaaatcccagcactttgggaggccaaggtgggcggatcacatgaggtcaagagttcaagatcagcctggccaactggtgaaaccctgtctctagtaaaaatacaaaaattagctgggcgtggtggtgcgtgcctgtagtcccagctactcgggaggctgaggcaggagaatcgcttgaacctgggaggtagaggttgcagtgagccaagatcgttccactgcactctagcctgagcgatagagtgagacttcatctcaaaacaaaaaacgaattcccaacaatgcctcagacatggcttaagctgcccactggggctctgcaggtgggatgtgcaccaccaagctctcaggtggggcattacctgacagcccagaaggactccgggccctctgcaaagtgcctgatctcttgcgcaccttaaaaggtagcttttcaggctgttcttgttcttttcatgctgacgtaggagattttatcctctgctttttaagtagaagcttccttaccctcctcatcatcctgagtagatgcctaggctggtttcagagaaatcaaaccagggtggattatgagttatattagccaccagctgtcaatattctctgaatgcccagcatccatccatgctctctgaccatcaccagagtgagcaaatctctgacatgtggataagagtttcttccatgggctcccagccaggctgtaagtgagaccagaatacccttccttcagtgcatggggctcagtgcagctgcctccctgacagtctccctgggacattaagcttgtcagcttctctcttccaaatgcaggtctggttgtcctaagcccagctcagcgctgctgtggactttgcatcctaaaaacattatcaactctgccttgtgcctcagtggactggcctggaggaaacaatatgaggtgtcctggctctttccacccccagcgtctctctccctcagtggtaccagtacggtcctcatgacggttcatctatacctgccaatctaggcctccacactgccgactgtggatggtcacagaacccaaaatgctaatcagccttaagcagatcatgctaatagtttctgcagatctgggtgcctcatcccagatctaggagttcacaagctaggccagctccagggagataacatgtatcacagagtctggacacgacaaagtggctttgctgtatttttgctgggacacatgatggtgatatcaataagaactggctcaggtccctgcagcttaaggcccattgaacaggaaagcagccaggaggatgtgctgccttttgacctgtacacaaatcagtgccatgtgccgactgtgtgtgaatatctgtgcctgtgtgtatatttgtgtacatgtgtgtatgtatgtgtacgtgtccaagttggtgttgcaaggaagtgttcctactgtcaaatgtttcaaactcaaatcttttctgttttcctaacttacctgcttcttctatctctagtgcctttgttctgcactaagaataaggatgaagattagggtagtaatactagcaggaggagtaaagattcatatgtgtttaatacatatcaagcagtcttccaagtacttcatatttattaattcccttcatctcaacaactctatgagttgttcattatccctccgttttacagttgggaaatctatgatacatagattttgagaaatgggaaaactaatgcagagaaaagaagaataacatgcctgatgtcagaactagaaagtggctgacccaggagtagaatctcaggtcttctggccccagaaaacctgttcttaggcaccatcctgtcgcctgtcattgcatcaatgtggtaaggcattggtgtgtctttaaggctccagaaagttctttctactttgtatttattttgttttgtttttgagacagagtcttactctgtcacccaggctggagtgcagtggcaccatcacaggtcactaaagtctcaaccttctgggctgaagagatcctctcatctcagcctcctgagtagctgggactacaggtgaatactaccatgcccagataattttaaagtttttttgtacagatggggtctcactatgttgcgtaggctgttctcaaactcctgggctcaaccaatcttcctgcctgagcctcccaaagttctgcaattataggcatgagccactgtgcccaacctttactttttaaaagtatcatattgtgactttgagtgcaccagcagtgctctagtgctggtctattagaaatgtaattttaagaatatatatatataatatacaattttttagtggccacatttaaaaggtaaaagaaacaggtggaatttatgttcataatatattgtgtttaaatgatttatccaaaatattatttcagcatgcattcagtattaaaatattgagatatttattttatttttgtactaattctttgaaatctggtgtgttttactcctacagcacatcttacctcagactacccatgtttccagggctcagtagctccctgggactcatggccgccatattggacacagcaagtccagatggataaaggtccatttgggtcacagcccctgcagtacatactgacagctacctgggaagaatggagagttccatgacccaaagggcctcctgagggaggaatggcagctctactttccagccaaagcaggaatattgagggcactaagaaacaagggaatttttacagtgtgtttcacacttcttcccttctcaaagacattaaatataacttcaattttaaaggtgaacctcggccatcaaaggcatgttttctattggtctctttccggtggaatgaatggcaatggtccctgtaaattgtgctccaaggatccctttcagtgggaagattcttgtgataagcccaataacaagtaagaaagcaattttttatacatagatctagaacaaaaagggctcatgatgaagaatattttattgaagcttagtgtattgctatttttcataaattgctgtttttgcctatcccacaagcactgatcacttttatgaaggtacattctccaagggtcgtcttagcatgtcaggacccacaagcaaaggtgttacaagtgacctgcacgagtggccagcaggacacctggaggagcccagtgagatgaggagtggatgcgcatcaggtgggaaggcatggagaagctgtgtgccacacactcaccaaggacaggagcgggcgtatttgtggcctgtggcctaatcttaggtcagttacctctttagactaaatcccaaggagtcagcacatggaggtttcggtccgtgcacatggcacctacagggcttcacatgacgttgctaattacaatgcagcggcacttacaaaggaattagtttcatcacatcctcagcagaactaggtctaaaaaccaatatatatgtataggatatcaggtgagaaatactttcttgccaatcatgtgtattaacgttaaagtggttcagtatctagtgtgacagttgttcaggcttagtggccttgaccacgtcaaaaatggaatcctgatcctaacttgtctagagattagcctggcacaaggagcatgaccaggcatctggatgtccccagtgtcactgcagacacatgctcctttttcatctgccagagggagcattaggatgtcctcacctctgtccccagaactcaggaagggcagtacacctgactaaagagtagagggttgtgaaaagagggacctagggcactggataagcaggaggagaaggagcactgggtgggaggtagagaaaggagggggctgaatggttaggctctgaggtgtgtctcctggatggagtcttggattccactcactaccatctgagaactttgagaaaaccgtgtaacctcctgatgttgggtctcttgtcagtagacatcagtgctttcctgatgtatagggttactgtagaattataatgaatgcctggttgaggtgacatgtctaatacaccctccaaagcatcaggcatatattaagtactcataagcaggcattctgtgtgaactagtcatacatggaagatgacattccccgtgtgggcacagtaggatgctgtggactttggtttggggaccctaataacttcaagtcccctggtagcacccaagtgtaaaaggcaaagggcatgactggtgcttcctgtgaggcctcttctatttggtaaaattcactctccactcatcgcacccacctggcctttattctaaacttggaaaattgctaacatgaaggtctcagcctcagggctcagataagaactcagacacatcaatagagaggatggctgaggtgcttggccgagctcagtgaacaccccagaacaggaactgaggagtgtatgcatgtgttgggggcagcactttctcactcatccagaaagtgtgaggaatctgtacagaactggggacagggcccatttttatacccttctataagcccagcccttgtctgctcactagggagccattcaccaaggccacaggagggaaggaagtagatttgcatgaagagcatccccttcctatgttaagagaggcctggaggccccttcccagctgtggactcagaggcagagctctggggcatctccaccatggcctggacccctcccctgctcaccctcctcactctctgcacaggtgctgcctcctagggctcagcccccacaggaccaagaatcagcctggccctgacattcagctcagcacagggagtaatgcagggtgtggggctctggaaatgagacccttatcttcagactcacctcttctctcttctcttgcaggctccgtggtttcctctgagctgagtcaggagcctgcagtgtctgtggccttgggatagacagccaggatcacctgccagggagacagcatagaagactccgttgtaaactggtacaagcagaagccaagccaggcccctgggctggtcatctaacttaacagtgtccagtcttcagggattcctaagaaattctctggctccagctcagggaacatggccaccctgaccatcactgggattcaggttgaagacaaggctgactattactgtcagtcatgggacagcagtcgtactcattccgcggtgacacaggcagaaggggaagtgagacaaaaaccttttctccatctgtcacactctttcttcagctccaggaaaaaactgtggacaaattcatgagcaggtcttgccctgttcacccagatatgagaccttgaggctgcccttccctccaggtctccaggtaggctatgaaaagggtgaatcaggagtcaatacacacacaattattataattttattcttgtttgaagaagaagtagaggaataattgaacatgtaaagtgaaaacatggaaaaccgaaaaagaggaattattgaacttgtaaagatgaaaactacaatgtctgaaatttagaaaatacactgggtgagtttgacaacagaaaaaagattagctgcaaaaaaaaagattagctgcaaaaaaaaagattagcaaattgtataatacagcagtagaaattgtccaagatgaaacacatatgggaaaaataattatggaaattaatgatagaaaggaacagagtatcagtgagttgtaggacaacttcaaacagcctaaagtatgtgtaattagtgtttgaaatagaaatgggtggaggagaaatagaaaaaagtatttgcataaataatggccaaatatttttcacctttggtgaaaaccataaactgaaatatccaagaagctcaacaaaattcaagtataggagacatgaaggaaacaactccaacataaatcataatcaaattaataaaatccagtgatgaagagtcacctaaataataatgctaagagcagttctcattaaaagcaatgcaagaaagaagacggcggagcaatgtcttgaaaacactaaaagaagaatcctgtcaaccttgaattctttttcttttcttttcattttctttctttctttttcttttcttttcttttctttttttctttattttttttttttgagacagggtcttactctgtcacccaggctggagtgcagtggcacaatctcagttcacaacatccagggcttacatgatcctcccacttcagcctcccaagtagctgggaccacaggcgtgcaacactatgcccaggtaattttgtattttttgtagagatgaggttttaccgtgttgcccgggctgatctcaaacttgtgcacttaagcaatctgcccgcatcagcttcccaaagtgctgggactccaggtgtgaaccactgggcctgccaaccttgaatttttttaataaaaacaaacaaacaaaaactttcaaaaaaggagacaaaataaaccctttccagacatatgccaaattaaagaattggttgctatcagactcttacaattagaaatggtcaaggacatccctagacagaaggaaaatgataccacaatgaaatgtgaatttataccgaaaaatgaaaacatcagatatagtaaccacaaggataaacatagaaacctctgaattgtgttaatgtctaataaagataattaacacttcaaagaaaagctaacgtaaatacattgtgatttgtaatgaaaatgaaagtaaattatgtgacaaagcacaaaagctgaagggatgaacaacatgttataatggtcttatactatatgtgaatatataataacacttgaaggtaaaccttgataagttatatacgtactgtaaacccaagcaatcattaagatcaacttttttttttttttttttttttggagtctggctcagtcgcccaggctggagtgcagtggcacgatcttggctcactgcaagctccgcctcttgggttcacgccattctcctgcctcagcctcccaagtagctgggactacaggcacccaccactacgcccggctaacttttttgtatttttagtagagacagggtttcactgtgttagccaggatggtctcgatcttctgacctcgtgatctgcccgcctcggcctcccaaagataaacccttttaacagaaataattatggctagtaagccatattagagttctccacagaaacaaaatcaataggatatgtatgtgtgtatatatgtataatgtatatatgtgtatatgcatgtgtacatataatgtatatgtgtgtatatacatatctaggtacatatatatggagaagaaattggttcatacaattgtggctgactaggatgaaatctactgggcaggctgaaggctggacatttaggtaagagttgatctcgcagttttgagtctgaattctgcaaggtgggacttcaggaatcctcagtatttgctctgaaaaccttcagctcattaatgatgcccacatgcattgtggagagcagtgtgcttatataaagtctacagatataaatgttaatcacatctgaaaattatcttcgtgccaacttctatactcgtatttgacaaaatcaactaggcactatacctagtcaatctaacacttaaaattaaacatcacttaaaccagcaaggagataaaaagaaataatttttaaaaatcagtcaaaaaaaggaaacagaaaaagggaaggagaagcaatgaacatatggcacaaatagaaaatgaagggcaagttggcatatttcaaccaaattatgttactaatcacattaattgtaaatagtctaaatatcacaattaaaaggcagagattgtcatgttgaaatgaacaagactcaactatacatgctgcctagaaaaaaaaccacttcaaattataaaaccacaaaaatccaagtacaaattaaggacaattccccccactcccaagtctgtttcacaaagcagtacaaagaaggattcacagtaaattttttttttttgaagtcttactgtgtcacccaggctagagtacagtggcaccatcttggctcactgcaacctccaccttccaggttcaagtgattctcctgcctcagcctctggagtagctgggattgcctgccaccatgtctgatgaatttttgtagttttagtagagacagggtttcaccgtgttggccaggctggtctcgaccttctgacctcaagtgatccgctggccttagcctctcaaagtgctgggattacaggtgtgagccaccatgcccagcccacagtgaactcttaacacacagttatagaaatatgcatcacctctcccatcaccctttcctctctctggcttccaaaaccttggttctggtaccagagctgagggaaaacattccacagaaatattaaatcaaggtgaagaagggagattctcaagatgtaagtaaaaggcaaatgagggaatggaagtcgcaatgcccttgcatgcataaggacagctcctgcatgagaatgttgtttgaaacattaccgaggaattggtgtccatgttcatgcaggacataggtctataggatatttttgtcatgcctttgtcgggctctggtatcagagtaattcaggcctcaaataggtagtagggaaatgtttgcttctcctctatattctgaaggagattgtgtatgattggtgtcatttcttccataaaaacttgatagaatttaccagtgaagtcatttgtactaggtgggcttttcttagcaggaagattttaaattgctaattcaatatatttatgtgtcatagatctattcagattttctcctttatgaatcgattttgataatttatgtatttccagatacttatccacttcatttaagtcatccataattttggcatttattgttcgcattattccctataaccattgtaccttttgtaaggtcagtggtgatgtcactctttaagtcatggttttgacaatttgggtcaggagaagatttggaggaggagagaacaaggttgtcttgatgttgtcttggctggagtgtgacttggagaaaaatgacttgaatgaaaatacagtcagagggagatatctgtcaagtggttctggtgcctggatttccacatgtgtggtgacggagcccagcccagtgctctactcatgcccagatgtcctggattattcccctgaaatactcaggtgaagctccagctacaccatggcatcctgatattttaaacagagaagaccagtgtcatgggcactggtgatctgctcctcagggcagactcactaaccgtggcagctgggaatcccaggggcctcacagctctcactaaccgtggcagctgggaatcccagggtcctcacagctctcactaaccgtggcagctgggaatcccagggccctcacagctctcactaaccgtggcagctgggaatcccagggccctcacagctcttttctccctcaaattgctgctggctacagagaactgcctccaccaagggcatgcccctttcacagtgtggctcaggcctaataactgcatgagactgaaataccaaggccctgtctcaggttaggatgaccttgcagggcctcccagatgagtcctcaactggagtcagatttcaggctgcccagttgtgcccccccatacttccttccagagcgaatatctccaaacactactgtatgcaattttccctctcagagtctgattccagggaacacaaaatagaaaacagtctacaaggaagagtacggaagaagagagagcagcacagagacaggactctggaatctgcaaatattcctgagcactgatgatcccatgagtggaaggaaaatacttaaggccaagaaaagaaccacccaaagacatttgagggaacaattgcagggcatgtgcatgcgcgtgtgtgcgcacacacacactcacacacacacacacacaccatcagaatagagtttgttcctacaaccagtgtggaaatgtgtctaatcagaggcatcaggttaactaatcagaatttctctgccctggctgagcaaagtggcttacacttgtaatcccagcaatttgggaggctgaggcaggaggatcacttgaggccaggagttcgagaccagcctgggcaacattgtgaaaccccatctctacagaaaacttaaaaaatatagctaagcatggggacatgcacctgtagtcctagctaatcaggaggttttaagcatgaggactgcttcttgagcccaggagttcaaggctgtattgagccatgatctcgccacacagtttcaaaaaaaagaaaagaaaagagaaaaaaaaatgaataagaaaagctctgccttagtatagggggaactaactatagactaaaatctgctcctatccctcctaggacaccgtaagagcaagttcagaaaggaacatactctcttcaagaaacccttctgaatcaaagaagacaaaaatatgtggagaaatataaaaatatcatgcacctaaaaagcaaaacttcacgatgtctggcatcttattacaatagcaggacaacgtgagtcagaagtaaaaaagttggtcagcgcatcatggccctgaaattgcacaggtaatacactttctagaccagaacaaaaagcagttgttgtaactgtaatccatttgtcctggagggtagagtattgatggaacaagttaaatggagacatgaaagacatttaaaaaacacctacatttaagtcctagaaatgaccacagaaatatatgaaatcaaagtactttgaatgagattgctggtatattacatgctgaaaaagaagagattagtgaatctgatgatatagtaatgagaactattcaaaatgaaatatgcaaaactactgaaaatgacaagaaaagagcatcgttgagttatgggacaactgcatgccaatgcaacctaaaataacgtaatttgtgttactgaaaaaaagaagttggtgggggtaggggagtatatagaaaaactacaaaacaaaataatgactaaaaatgatccaaattttgtgaacatcataagccatccattttcacgaagctcaaccagcccctgacaaaatatattttaaaatataaatacgttaagataacaataccaacacatatcataatcaaattgctaaagcacagtgatgaagagacactcttaaaagcagccagaaagaaaagacatgttagatataatactaagagcagagttctcattagaagcaatgcatgcaagaagacaggtagctacatctttataatattaaaaggaacaactgtcaaccctgcagtctttacccggtgaaatatctctcaaaaatgaaggccaaataaaacctttttcaaataaataaaacttacagaattgataaatcacaagccgtcactaaaagaaatgatgaaagacatccctcatacagaacaaaaattataccagatagaagtgtgaatctgcacaaagaatgaaaagcatcagaaatggtgactacatggataaatattttaatagtgcataatgtagaaataaaagggcttgaacagcactatagaacaactagacttaaccgatgcctgtagaactcttcaagcaacaaaagcagaatgcacattcttcttgcatgcacatggaacattctccagaaaaaccgtataaaacagattgataatttttaaaaagatagaaatcacacaaagtatgttcccaaaacaatgtcattagagaaatccaaaaaattgagggaagaccatgaaaactgcatgaaaaaaattgagatgaatggacaaatcactagaaatacaaattctattagaagtgactcaagaagaaatagaaaacccgattaaaactatagaaagagattaagttaataataataagaaaagccttcccataaggaaaggcccagacacagagggcctcactggtgactattaccaaatgtttaaagaagaattaatataatttatcattaaacttttccaaaatataaaagagataaaatcacttgccaactctttctctgaggccaatattaccctgataccaaaaccagacagagccattacaagaaaagataaatacagagcaatgaccttactggatatagatactaaagtccttaacaaaataccagaaaatgtaatctaacaagatataaaaagaagtacatacaataaccaagtggtgtttatccgaggaatgcaatgatggtttaacatctgtaattgaattaattaatagaaggcatcgtattaatagaagaaaggacgaaccatattgtcatctcaaaatcacttaaaatgttttcatgcaagcagactttctttcttgctgtttttaggccatcatgagaagtggagatggcatggggtagtatttcatgcaaagaatctggatattccatactcaactgtgaggatactttctgataaatgtaaaagattgtaatattacgtttctgtatgttcagagaacacttcctagacaagatatgtgtacagaaccgaaaggacaattaggattttggcaggcattgagtgaggagtggagtcactgcaagtgtcagtcagagaacaagaaagatgttaggaaccatgtatttctacctggccatcctactgggataccatccccttcctaacacatcacccatgtggcttgtaaaaatgtccatacttgaaacattttgtccacataattacaggtctagtgctggaatcaagttccctttgatgacatcaggacagttaaaggatctgcgtgtctaactgcccccaggtgatgctaacattgctgccctctgaggaccacaagcaaagtagctcagctcctgacctcctgctcccagcacaggtgagatgcacctcagctacatctgtgaagcccaggagactttctctccctcctcaggctccctggagtgatgacccaggactcatgcctctgcacatttatcctttccctcagagtttggggccttatcagtcctgttacatcttctcagcatctgaaaccactggagaggtggtcaccatctcctgtgctgacacagcagtgacattgggggttataattctgtctcttggtaacaaaagcaacagggaagagccccatatgactgaggggtgagatcaggaaaaagcctcagagattccagttctaatctcaggccgttctttgtattcttttatgagctagttagtcagctggtcagtcagctgtggccacaagaagaaatggaagagaggttcagaaaacagccctagagaccatagacccagagctctagagacagcaggcccaatgtgctacacagggccacagggaaaggcatcaggttcattagaagacagaagacaggagggcaggggatcccttagaccatgacttttatcagaatttcctcaggaaaagcagggcaagctaaaaaatttatgattggccagcctgaataatgtcagcaggctttgggctactaaggtggtctctagctgcttggtacctggccctgggacgataaaggcagaggaatattgtatcctgggatgcacaaaccagacaggggtggtgaggctctgaacacgttagtttccatatgaaaggcaggcttctggctgagcccattgctctttcaaggaatagagaactggggagacccaggaggggtggtcttttcccagacagaaatgttttttaagatgtcaaaatatcaaaatatatagaaaattatatacagttgacccttgaataacattggtttgaactgcatgggtccattgattttcttctgcccctgtcacccctgagacagcaagatcaacccctcttcttgctcttcctcttcagctactcaacccgaatataaaaaagataaaatcctttatgacgattcagttccatttaatgactagtaaatatattttctcttccttatgatttttaaaataacattttctgttctctggcttacttcattataaaaaatactgtatataatatacataacatacacaatctgtgttaattgactgtctaagctaggcctggctctgaccctgatcctgggagacactttaggcagattactctggaaataagtccctcagtctctgaccatctctctctcctcggcgggttctctgtcctcccatgggagctcagtgcccatggtgcagacagcccctctcagctgctcaggaccaagtagggaagctctgctctgtcttggtacccgcagaacccaggctggtgcccatgctgggactttaatgtggtgacaaaactcctcatgcagtgctgattgattctctgacagtgtctaggaatgtaattcccctgaccaggggacaggttgaggatgagtttcaggggggatgacaacaagacttccaatgacacagccacagggagaattgagatgcacaatctgctgtccccagcctggatcacacgctccccctgcatttaggaaagttgcttagaattaggctgaagaggtcaggattcagttttaacattgacctctctctcattttctcttttactctcttttctccttctctcttcctctctctttctttctctttctctatgatactgaagcccttattcacccccattctcagctatgaaatggacatggaaccctgacatcgtgagtttcctcaaggatcacaggagtggagtaaagatctgagccctgtctccaggtgtcctcaagggtctacatcacaggctcctccatcctgctcttcccttacacaggggctcccctcagatcctgcccatgcctaaatttaggccccatttctttgagacctgtggacacttcatcctgaggttcctgagggtttttctccctgctgacgggagatcccactgatcacatggtctgcttgttgtttctcaatcctggagcacagctgcaagtgtcacctgagacacggccaatcccccatacaggacagcagtgaaggtggaagaatcccagagtgaccgggtaccgtcattcattcaaattccatggggctcttgctgcatcactgggtgtcatcctttgggaacctggacttctaaactataagactcagagttagaaaacagaatcataaattccccatgtaagccactacttccacccctggtcctggactcagatatgttactaatgaggaacacagttcctcatagtggctgctgattgaggacatggtgggcaaactgtggttgatggacacatctgtcttgcatcctgcattggaacacagtcttgctcatgtctttatgagtgacatgtggctgttttcatgctgcaatacaaggcttggttgtggtgacagagatcctatggtctgaaaatctgaaatactatactaaaggtcccatactgtatcatgtcttctacatgaattatctacaatagacaaatccatgcaggcagaaagaagatgagtggttgcccagaattggagaaggtgatgaaagaggagaggctgctcactgggtgcagaattttcttttgggtgatgaaaatgtaggagaactacacacacagctggtggctgcccaacaaagtgaaggtgctaagtgccactgcgttgtacattttgaagtgattaattctaggttatatgaattccacacaatacaaaactatgattttcagaaattgactgttataattgtgttattatatctacaactttatgatggcactaaaggaccatgagcagtcaatgcaaaggatccagacaatatttcaagggctcttccagagtaacaagacatgaaaaggcagctctggttctctcttgcctggcgtattttaccctcggagttttttgtttttttgtgttgttgttgttgttgttgttgttattgttgttgttgttgttacagagtctcgctctgtcgcccaggttggagtgcagtggcgcgatctcggctcactgcaagctctgcctcccgggttcacgccattctcctgcctcagcctcctgagtagctgggactacaggcgcccgccaccgcgcccggctaattttttgtatttttagtagagacggggtttcaccgtgttagccaggatggtctcgatctcctgacctcgtgatccgcccgcctcggcctcccaaagtgctgggattacaggcttgagccaccgcgcccagccaaccctcggagtttttatgagcaccgaagggtgcagggagctggaagctacccaccaggtgcctggctcactcatgtctgggtgcagcagctcccccaacaggcagctggcagaactgaaagggaagagctatatccttctgagcccccacaattgtggtgcaggattgttcccgacactcccatccagtctgcttgctcctgcacacttagaaatgatcattatttctgcccaggacctccctggtcttgctctcccctcttcctccccaggcgaccttgggaactttactcaccctctggcccttccctcctctgtccagtgttttccccacccactgtgatcagctcagatcagcgagtctgtgggacattagggatcagtcacccatgtgaggccctcgacggggtcccaggatggagcagtgtatgtccccacaaggctgcttattgcacaagtaatggaggaacaaaggggtgggtaagccccctcctgggcagcttcagaccctgctaaaataggaaacagcctggggcaggtctgaccccacttgtgtctctcctgcccccaccccagcagcagcgtcctggaggccataccatgtgctaagcagatgccaagatcacgtcattcatcatcacctggaaattcccctaaccacaccttaatacgctgcactcgtgcctcagctaaaagtatcacacactgcattgcaatgagtttggatcccagacccccttgatgtttgtcactgctctttcagatcctcgaaaacacctacccctccctgcaggtcagtgacagactcttcttcctcacacttcctttcactgtttcttccttcctgagagcagctccagagactcctcttcagggaggcgccccaacctctgattacacagcagtctgcctgtcattttctgtgtatgcattctattaatgatctgcagagcacctaaacttcatgcctcttttcctaacatgtttattaattgattttctggtgctaaatactcctacaatcaatcaaaaatgcttctcctctgcttggacactcatgagaaacagtcatgaaccatttgctattttatcctcaaaaagtaagtgtggagttcactgctgttccccacatactcaccaaataatgagaaacccagcaattacccaactttctgctccaccatcatgacacagtaggcttttctttcatttgtgtggacttaagacctcaggatggctgctgcagctccagctattatacccatattcaagagcaaaggtgctgcacgaaaacagtctgtttatttccatcacaagagaaaatgttccctgagaagatctccaaccacctgacccttacagccctggggccagcatgggaccatgtggtcagtccaagccaagagtgaccagggaaaacaaggatctttttgtaaataaatagaggagaaaatacacaggtagaagatggtgcttctactacaaactgtttctattacacagccccaacccccatgtaggaaactcctggggtcagagacagtctttctcgtgctgaattcccaggatggaatattgccggatcagagtgggtctcaataaatactggctgggtggatatgctcctgcctttgtttttggggcaggagccaccactgcctcatgtttttctacacctggagccatgaaacttggtgtctgaggtctgcggcactatatgcagagccttggtaagatgcactggaccacttaccaacccagtgacagtagagggatgtcttaggtgggccctacccattttcctccaataggacgtgctcataatttcatgggtaaccgagccccttatgcctggtattgaggcatataaggccaaataaagaagaggaattcctctcttggaaccagcagtccatggacaagggaatcagggacctgagcagcaggttctgaatccacacctgatctggggcaggacccagaacctatcaaagtcttctgctgttaactatagaatgggctcacaaaatgcagacagaatgatctgtgaactccacctggcctggctagctgagaaccaaggccaagacatagtttaaggtaaagatgttggcccagactttgggaccagcaagtgaaggagaattctgtgggctgaggtgggtctgtagggtcctcccctcccctctctgtgtcccttggggctgagcccttctctggaaactacaaagctactccagtagcagcccctgattctgctgacttgcatcacgggccgctttctccatcaaggggataagagaggcctgggagaaacctacccgccctgggccacaggaagcagcatcagggatgtctcagtcatggactggacctttctcagcctcctcgctcactgcacaggtgctgccgccagagtcccagccacccgcccagccccgggctgtgggaccaggctggccttgattgtgagctcagcagggctctgcctgtggtggaaaggatgctcatgaccttgctgcagggtgaggggctggtaaggttgaaatcttcctgtactcctgtgctcatgggcactctgaggggcacagtcaggctccctttcatcccagaagctctgtcccagccaggcaggtgcaaaggaatcctgaggatcagctcctcagcttcaagccttttctccctcatctcctgcaggtttcatggccacatatgagctgtctcagccaccctcagtgtcagtggccccattacagatggccaggatcacctgctgtggaaatactgttggaggtggatatgtttattggtaccagcagaagtcaggccagacccctgtgccggtcatctataaagacagcaagtggccctcaaggacccctgagtgattctctggctccaacttgtggaacacagccactctgaccattagtggggcccaggccagggacgaggctattactgtagcacctatgatggctgagggagcagcaggcagtggctcacagtgaaacagacagatggggatgtgggacaggaacctctaatataactaggctcaatatctcacatcctctctaagccaggatgtccaacattttggcttctctgggccacattggaagaagaaaaattgtcttgggccacacataaatacattaacactaacaatagctgatgagcttaaaaaattgcaaaaaaatctcataaagttttaagaaagtttacaaatttatgtagggccacgttcaaagccatcctaggctgcatgtggcctgcaggctgcaggctggacaagcttgctctaagcagtgaccatgactttggtctcagttcactcaggtggtttctcatggtagccaaagcagcaggagaaactgtcggatttctatttaaccatgaattttacaattacattcattgtaaatccaaacatcttgtccctttattacctgggccctacagagactagtgcacaggttcatgggataagaaatgtctccagagagcttggtttctgcactagagacagtcgtttccctccctttcaacacagagtgtggcaggaaaggaaccagttctctgagctaaccctgagaacttgggcttgagaaaaagaaagcattttgaaccagtaggattgtgcccacagaatgagatgtgctactctggcccagcccaactcctttcatttcaggagctctgtctgggccaggcaggtgcaatggaatcctagggatcagctcctcagtttcaagccttttcttctctgggtgtctgagaacaggagttgtcttgcacgtgcacatgagaaagaagtgcacacacgactctcaggtgtgagcagcaaagacagaacaaacctttccagaaggggcaaatttcattaagatgacagggccttgttacacaaccccacatgtctggactgggatctcctattggatcttgccataaatgcaaggtttcttctcccatcataaattcctgcattgcagtagacccagctgggttctagggctcaaccagcagggcactcccaccactgtgtggacctgctgcagagccttcctgctctaggacccacagacatgcaacttttctttgtttttgctatttgggttggagcaacatcccaagagtgaataatgcttcttccagaatccatcatgaccatatatacttcttgatgcgaagttaggatgtaataatgtgtcctttttttctatgggaggtgctcagctgttccaaacaagaagaccctaaacatttctgctcatatgaaggatgactccctaggtttgctttcctattctctgaatgcatgggtctccccaaatcttccaatgacctttcactgcatgcacatctcatccaaataccaccacatggtggatgcttgggcatggtagcgggtgcctgtaatcccagctacttgggaggctgagacaggagaatcacttgaacccaggaggcaaaggttgcagtaagccaagattgcaccactgcactccagcctgggtgacagagcaagacttggtctcaaaaaaaaaaaaaaaaaaaaaaagaaagaaaagtttatatttttgttctaatggttatcttaatatcttcattctataattatatgttttatataattataatagctatataagatataatacccctagtatgttgttttttggatattctacttgctcctgatggttaatttatgtgtcaacttggctaagctatggtgtcccgttgtttggtcaaatacttgtcaatatcttgctgggaggttatttcatagatgtgattaacactgacagtcaattgactttaagtaaaacagatcacccaccataatatgggtgggccacctccaatcagttgaaggccttaagaacaaaaactgaggtttcccagagaagcaggaattctgcttcaagactgtaacacacaaaccctgcctgagtttctggcctgctgactgctctacagattttaggttccagacttcgagatcaactcttacctgaatttatagcctgctggtttgccctacagattttaaacttgctagtccccacaattatgtaagccaattcctaaataaatctctctatgtataacctattggtttagcttctctgaaaagctttcacatccagtttcctggatgttaagaattactgaaactagctagtaacttactttttttttttttttttttgagacagagttttggtcttgttgcccaggctggaatgcaatggcacaatctcagctcacctcaacctccacttcctgggtccaagcaattctcttccctcagcctcctgagtagctgggattacaggcatatgccaccatgcttggctaatttttgtatttttagtagagacacggcttctccatgttggtcaggctggtcttgaactcccaacctcaggtgatccgccgccttggcctcacaaagtgcctcacatgagccaccacgcctggctcctagtaaattcttcttttccgtgatgtgtctcttacctctaataatacttttcttcttaaagtctacttcattaaaaatagttatgctgggcatggtggctcatggctgtaatctcggcactttgttggaggtcgaggtgggtggatcactgaagcccaggagttcaagaccagcctgggcaacatggcgagaccctgcctctacaaaaaatacaaaaattagctgggtgtggctaatataattctaagttggcacacttgtagtcccagctacttgggatgctgaggtgggagaatcgcttgagcctagaagggagagattgctgtaagccaagatcacatcattgcactccagcctgggagacagtgaggctctatctccaaaaaaaaaaaaaaaaaaaaaaaaagttatacagctttcttggttagtacatgcatgacatatttttcattattttctacctctctgtatccttatataaaaggcattagttgggttttactttattttcaattattttaatttttattgtccttttaaatgtaactaatgatttatttacgttgaaacccaccaccaatttgttttccatgcctattctatttcttcttatctcctctcacatcttgttttggatttattatttttattatttaatttcctccttctctattagtttcataactgtgcagtcttagagttattttaaaagatgacagtggattattttagagcttacaacatgcatccttcacttatcaaagcctaacatgagctagtactttttgttgtggttgagacagagagagtcttcctctgctgcccaggctggagtgcagtggagcaatcttggttcactgcaacctccacttcttgggttcaagcaattctcctgcttcagtcacctgagtagctgggaccacaggtgtgcaccactatgcccggctaatttttgtattcttttttagtagagacagggtttcaccatgttggccaggctggtcttgaactcctgaccttaagagatctgcttacctcggcgtcctaaagtgttgggattacaggcgtgagccaccacgcccagcctatgagttagtacttctatcctcttcctagtcagtagaagaaccttggaacaggaactaaatttacccccagtgacttatatgctaatatttttgtgtattttaaacatatgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttcagtgcaaatcccagatatataactgtacccatacatatttcagtatgttttatttattttaaaccccacaagatatcattttctatactactgtaatttcataccaataacattcatttagatttacccacacatctacctcttctgttaccctttatttttatttataaaaatatctttgggaaaaaatatccttcagcacatggtcaaggatctcctgagggctatgtcatggacaaaatatacatatatattccatatatatacacacatatacacacacacatatatacacatacacacacacacacacacacacacacacacacacacatatatattccactttcacttttttgtttgttttttgagaccgagtcttgctctgtggcccaggctggagtgcagtggtgggatctcagctcactgcaacttctacctcctgggttcaggtgattctcccgtctcagcctcctgagtagctgggattacaggtgttagccatcacgtctggctaatttttgtttgtttgtttgtttttgagacggagtatcactctgttgcccaggctggagtgcagtggcatgatctcggctcactgcaacctccatctccctggttcaagcaattcccctgcctcagccttccaaggagctgggattacaggtgcatgccaccatgcctggataatttttttgtatttgtagtagagaccgggtttccctatgatggtcagactagtcttgaacttctgacttcaggcaatccgcccacctcggcctctcaaagtgctgggattataggcatgagccaccgtgactggcctgttttttttttttttgagatggagttttgctctgtcaccctggctggagtgcagtggcaagatcttggctcactgcaacctccacctctcgggttcaagcaattcttgtgcctcagcctcctgagtagctgggattacaggcatccaccaccacatctggctaatttgtgtatttttggtagagatggggtttcaccatgttggccaggctggtctcgaacttctgacctcaggtgatccacctgcctcggccttccaaagtgctgggattacagggaggagccaccatgcccagccattttcacttttgaaggatattgttagtgagcatagaattctaggttggcagatattttctttcctcagtttgaaaacatgattccttgtatctgatttctcctgcttttattgggaagccaattctcaatctaattttgctcatttgaaggcaatggctttttatgttgttgtgttttctgagatggagtcttactctgtcgcccaggctggagtgcagtagtgcaatctcagctcactgcaacctctgcctcctgggttcaagtgattcttctgcctcagcctcccaagtagctgggattacaggtgtccaccatcacacctggctaattgttgtatttttaatagagatgaacttttgccatgttggtcaggctgatcccaaactcctcatttcaggtgatccgcccgcctcagcctcccaaatgctgggattacaggcatgagccagcccccaaccctggcctgaaggcagtatcttttttcctctggctgctttgaaaagttttgtctttgttttgagcagtttacactgatgcattgaggtggctcttcattccatgacttgattcttttttgtccattttagaaaattgtcagctttatctcttcaagtattacgtcttccccatcctctctctactctccttatgagactccaatttcacatgacttatgccttgttaaagtatcccccatgtctcttaatccattcctgtatgttctatctatttttctctttgtacttcaatttgtatagtttgtatcaaactatctcccaattagccgggcgtggtggtgggtgcctgtaatcccagctacttgggaggctgaggcaggagaattgcttgaacccgggatgtggaagttgtagtgagccgagatcatgccactgcactctagcctgggcaacagagtgagaccctgtctcaataaataaataaatacatacatacatacatacatacatacatacatacatacataccagttcactattttttttatgtttgtgtctagtgtgctgttcaaattgagttcctaattccattttttttgagacttttttttttttgagtctctatctgttgcccaggctggagttcagtggtgcaatctcaactcactgtagcctccatctcccaggttcaagggattctcatgcctcagcctctcgagtaactgggattaccaccatgcctaactcatttttgtatttttagtagagatggggttctgccatgttggccaggctggtcttgaactcctggcctcatgtgattggcctacctctgtctcccaaagtgctgggattataggcctaagccaccactcccagcctccatttttttttttttttttttttttgagacggagtctcgctctgtcgcccaggctggagtagagtggtgcgatctcggctcactgcaacctccccctcccagttcaagtgattctcctgcctcagcctcccgagtagctgggactacaggagcatgccaccatgcctggctaatttttgtaattttagtagagatggggtttcaccatattggtcaggctggtcttgaacttctgacctcaggtgatccacccacctcagcctcccatagtgctgggattacaggcatgagtcaccacacctagtgcatccattttttgtagctgccagttttctgatgaaattcttaattatttctttatatccttgatacacatgtaaagaatttattttaaagtacatggtctgatgattttatattctggagatcctatgggcctttttcaaagttgtctgtgctttctcttgagttttgttcctgctgtcttatttccttgtttgcttggttgtttttaatttggcaatggaagttgtgtataaaaattgttacaaataattttttttttttgagatggagtctcgctttgttgcccaagctggagtgcaatgatgtgatctcggctcactgcaacctctgcatcccagggttcaattctcctacctcagcctcccaagtagctgggattgcaggcaggtgccagcacgcctggctaatttttgtatttttagtagagatgggttttcaccatgttggtcaggctggtctcagactcctgacctcgtgatctgcccacctcagcctcccaaagtgctgggattacaggcgtgagccactgcgcccagccagaaataatttttaaaaataatttcgagcccaagcatgatggctcatgcttgtaatcccatcactttgggaggctgaggcaggcagattgcttgagcctaggagttcaagatcagcctgcgcaacatggtgaaaccccatctctacaaaaaataaaaaattagctgggtgtggtggtggtgtgtgcctgtagtcccagctgtttgggacgctgaggtgggaggctcacttgagcctgggtgatcgaggctgcagtgagccatgatcctgagactgtactccagcctgggcaacagagtgagatgctgtctcaaataaataaataaataaaaataaaataatttgaggcctagggctctgaaattctgagatctcctttatgcatttgagtgactgagatgatctgaagctggatccagtgctcctgagggctgctttatttctggttgactgtgactcctagagtaagaaacctgcaccccatgtgtggggtattatggcatcccctccctcagccacatgagtaagtcaacagcactgctctagaccaggtgtggtggctcacgcctatagtcccagctactcgggagactgaggcaggaggattgcttcaggccaggaatttgaaaccagccagagcaatatattattaggttggtacaaaagtaattgcggtttttgcctttaaaagtaatggcaaccctgtttcagcaaagtaaaaagcaaaaaaaaaaaaaaaaaaaggaaggaagaattaaaaaaagaatcagctgggcgtggtggctcacgcctctaatcccagcactttgggaggccaaggcgggcagatcatgagatcaggagatcgagaccatcctggctaacacggtgaaaccccatttctactaaaaatacaaaaaattagccgggcgtggtggcaggcgcctgtagtcccagctactcaggaggtggaggcaggagaatggcatgaacccaggaggtggaggttgcagtgagccgagatcatgccactgcactccagcctgggtgacagagtgagactccgtctcaaaaaaaaaaaaaagaatcactgctctgtctctcagcctcctcttccaggattggccgtcgccttgaggggaatgctggccttgcctgtctccagccctgtacctctctgcctcctatgcctttaagcacatgttttctatttgctgggctgtgaaatctgctcttcatctgatggggtttgctttataggtgactagattcttttctcttggtggttttagatttcgcattttcacattgaccttaaatagtctgattatagtttgccacggcaaagaccctttgcattgcattgtttggggatatttgagcctcctctatctggatgtctaatctcttgttagatgtgagtagttttcattattattttattaatgggctggcatgtgggccttggttccaggcgggctcagaggggcagctgcctgatgtctgggcagcttctctttctgtcttttcttacctggactctgggttgcttgttagctgcttctgccagttctgagttttcaaggggagaggggcccagtgatggctgttctttgaaggaaagggaagaatgtctcctgtttaacatgtttctatgtttccagttacttggttagttagttagagccagggtctctcgctctgttgcgcaggctggagtgcaatggcatgatcgtggctcacagcagcctccaccttccaggctcgagcaatgctcccacctcagcctctcaagcagctgggactgcaggtatgtgccaccatgcttggctgcctttttaaattttttttttttaatacagacaaggtctcactatattgcccaggctggtcttaaactcatgggctcaagtgatcctcctgcctcggcctttcaaagtgctgatatcacaggcagggtttccattttttaaagctcccagcagtggtataaactcctcctttccagagaaagcgcactctgtccgcatccctcatgttgtcctctcctgcctctgcttagggttcactccgggggaaagtgccacttgagagtttcctttttatgtgtggttctgactgaccgctccctgctcacagatgctgcttctcagggtggggtccctgaggcctggagtgtggcctctgacgaccttcagggccaggtgcggaatgagagcctgtggccacatggcccccggtgggagacgtcccgccgccctttgcttctctgtgccactctggctgcacagttcagagccttgggaaacgttaaccagtaggacctagaaggggaggtgagaaggggtcaccccccaggtgtgcctgtggtgagccttcgtgctgagcaggtgcagggagggaggcccaggtgcacacacctgtgaagtaggggcagctggctgggctccttgacctgctccagagcttcttattttctggccacttcacctgcagaaggcccaggtggctgtagccgctagggtcccttgcagtggaaatgatgcctgtcctcagcccctctctaggcctggcgctgtgctcagcaccgtcgtgtgtgtgtatgtatatgtgcacgcatgtgaatgtgtgcagacatcatgaggtgtggtccctgctgttaggcagcttgccttgtggctgaagtgaaccatcacctgaatcaagggatggaaacacaaggccagatgcagtggccttctatggagtcagacggtggctccgtgacctggcttcactccagaactacctggggtttctagctgtgcaaatcccaggtcccactcagattatgagtccagttctctgcaggtggaacccaggaaggtgtatttttaacaagatggtactgctcattcacccagcccagccagtggtcttggcatacccaggaaccgctgacatagagcttgtgctccccataaagtgggaaacagagcgttcctgggtgggggacatgtggcttggtcatgacagtcagggtgttacataccaggacagactgtgttcgggtgacattaaggacaagctcctgcaggctagctgcctggatagtgctggctgggggtagaagttagaggggtcacagaggggcttcctcccggccccctcatcagctgcttgatttagggcttggttctgggtccttctgggcctgattctgaaccatgggactggtgtggcctgcaggctcctcccgccacaagctgttcatggtgcagggggagaacagtgtccacaattccccagacagcagctgtggatgccaggcccccaggagttgttactgaagttgctgctggacagctcgcctttcactgagctccacatagcacccgtggtgatgggagccggatggagagagcctgccagcctgcacatcagctcccaactgggcggggcagagggaggagggggtggggaccccaggcagcagggctctgggagcagtggggccctgggttccaggggtgtctggcaggcccctccttactctacgtctctcagcctctggatggaggtgctggccgcagtcgggctctgcctctgactaagggttggggaagtggcgggtgtgggctgctgccccgtggggcctctgaacagaccccagggcctctgccaatcatgactccttcctttcagctggacccacaggccctgcaggacagagactggcagcgcgccgtcatcgccatgaatggggtacgtgtccgtgggactctcctggcgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttaggccttaaaagcaatgacacacccaaaaaggcccgggtataaatggtaaaatgttaatatttgagattcttggctttttcttacattattctgtctttcctacttaatttttaattgttactaagagaaagctggtcacagtacactataatctcagctactctggaggctgaaccaggagaatcactggagcccaagagtttgattacagcctgggcaacattgcaagatcccatatcttaaaaaaaagtaagcaagcaagagaagcagcggggattttaggaggtgcttctgcagaaaccagtcgtttacatcatcttcaacaatcctggctcttgctgaagtagactaggggcttccccgaggggcggctccacctcatgctgagacctctgcatgccttgggggtggaaatatttgatgagactcccaggggtccttgggaccttgggctatgaggaccagaaggattagaggactgtgccccttctccccactgtagatcgaagtaaagctctcggtcaagttcaacagcaggaagttcagcttgaagaggatgccgtcccgaaaacagacaggggtcttcggagtcaagattgctgtggtcaccaagtgagtggggaggggcttgggctcacgcactgagggtgcctgtcccttcagctgtttctgcagaaaagagcatgtgtgggtctctcctctctgtgcgtggccactgcacggtgaggtcaggccccagggaacacggcgtcttcagctacctcctgtgtttcctgcaaaccagctcaggaatgtccttgccaccttgcttggaagcagtaggctggctccaggaactgcccaagtgcagggttttctgcccttgcttggaattagtcacggtcccagattcctgttgaatggttgtaacccctgcccctttgtcacgagtcagttgccaagagaagcctgtttgttggtttgagagcagttcatgcagacatagaccacttcctctgagaattcatttgcctccctaggatggaatctggctgggcctctgaccttgctggtcacgtgggccggggcctccatcagtcataccctggactcctatctgtgtctaaacaccacgccccacccccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagacgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcacatagggagcaggtctcctgtgttatggcccaagcagggctgttaggacactgagaacattccctcctcccgcaggagagagaggtccaaggtgccctacatcgtgcgccagtgtgtggaggagatcgagcgccgaggcatggaggaggtgggcatctaccgcatgtctggggtggccacggacatccaggcactgaaggcaggcttcaacgtcagtgagtgtcggcctgcgcaggacgggatggaggtgtgggcagtggtgtccgcgatgagatctcagagtgctccatggcccaggcatgtcacatccttctctgtgtcttttcttcatttactgttttattattttaaaaaaagagaaaacaagagttgtacaaacagcttctatagaagccagtttttacaccatcgtacccactcatgccacttggtggagtggaccaggggcttctgtggggacttggccttcctgccttgggggtggacaggaggtggaagcccaggactcagtgcggtctgtccactgccctgtatgaggatgtggtgggcagagggcactgatgaaattcagcgcaggccggggctgcagcatctccgcctccatctcaccaaccctcacaggctttgaaggacccagactggcctcaaatgccaggggagggcactgagaccccagagggtccctcccagcatcttcaaagcaacaggattttgtgcctgcaggcccttctttgcagcacacaccacccaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccatgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagtgtggcagggacggtgctttagccaaggcagggatggcgggtgactcactcaggatcttcaaggaggccgctgcatttccatgctctttccagataacaaggacgtgtcggtgatgatgagcgagatggacgtgaacgccatcgcaggcatgctgaagctgtacttccgtgagctgcccgagccccttttcactgacgagttctaccccaacttcacagagggcatcggtgagcactggaggccttggcctcgtgggagatgtctcccccatgtgcactgctgccctcggaggctgtgaaaagcgaggtgtgggaacctgagttgtaacccctctgccatggtcggcattttaacccaacctcaaaaagcaggggaccagaaccgagcctgtcctggaaggccttgcccatccccagagggctccccatccctattcctcaaggaggccaagtgggtgaaatggtcagcactgccgtgctgtggggtcctaaagtctgctgtcctccttcctgcagaccagggctaaacactggtgcccaggtgctcttgccatgggtcctggtccagccaagcatggtttcaaacatgacctgacccttagtcaacctggaggctgatgtctagagtgggcgctggagcgtgcagcacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgtccctcactccgctgtttcattccatgctgagcctcccctgccttgggctccctggggagggggtggtggcaggagttgcccaagggctgctctgcccatgagcagctgctctagcggctcctcctgctgctgttcgccaggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtcccgggcgctccatgtgaccacctcgggagaggtctccggcttgtcgtaacccaggggagtgacccactgcctcctgcagctctttcagacccagttgcaaagaagagctgcatgctcaacctgctgtcgtccctgccggaggccaacctgctcaccttccttttccttctagaccacctggaaaggtagcccagctctcttgtggctgcccaggactccaggtctccaggccgttggggtgcccctctgctcccaccagacccccagcaccaaggaccttttcccccgacccctgtctgcagtaactcactgcttctaaggactagcaccactgccacccctgcccctgcctctcctctttgccacccgcctccctctgcactgtggccttaacaaagagctcagagctttggccgtggccagcagtgcatttggaccgcccccacttccctcccaagcacatcatgaagacctccccatcagcccagagctggccccttgtcccgggccactgagacccagaagtaccaaggctggagtcagcttgcagcacagccagggtcgaggtcactccctccctgaggactctagcatggcacagcccctctgcctctctcctggtggtggcgttgaaacagcaccctctgcttcggtcctctacagggtggcagagaaggaggcagtcaataagatgtccctgcacaaccttggcacggtgtttggccccacgctgctctggccctccgagaaggagagcaagctccctgccaaccccagccagcccatcaccatgactgacagcaggtccttggaggtcatgtcccaggtatgggaagacagcctccagcccatgcaaccccagcctgacagaggtggcctctgcctgccccacccccagtcctgcccatcttcccacttgcattgtatgtggtggtggctgagattcagagagagggacttgcctaggtttgcatggatgggagtgatagggggtgcccaggccacctcctggtcctgctggtgcatcttgctgggggcttaaaaccaccccaagtgttcgggtgtggtggctcatgcctgtaatcccagcactttgggaggccaaggcaggacaaccgaacccaggtgtttgagatcagtctgggcaatgcagcaaaccccatctccagaaaaaatagaaagaaaaattagtcaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttgggggcttgggccccaaagacctccccaccagcagctgtgagcccccctctgagccactctcctcttccccactctgcgagggcaggtcgaggtgctgctgtacttcttgcggctggaggccatccctgccctggacagcaagagacagagcatcctgttctccaccgatgtctaaaggtcccagtccatctcctggaggcggacagatggcctggaaacctctggctaatcgggccatctgtagagtgggaatcaagattttctgaggcatccttgggccacccccaggtgtcaggccatctgccaagagacagtggcccaaagcagaaggacaggtggcctgggcagatcccgcccaggtctgaaagccccaggctggcctcagactgtgggttttttatgtggccacccgagggcgccccaagccagttcatcttggagtccaggcctggccctgggagacagggtgaaagcagtggtttttatgaacttaacttatagagtctaaaagatttctactgaatcacttgtcaagaagcgccctctctggggagaagggaacgtgaccggattccctcactgttgtatcttgaataaatgctgctgcttcatcctgtgggggccgtggccctgtccctgtgtgggtggggcctcttccatttccctgacttagaaaccacactccacttagaacagggtttgagaggcttagtcagcactgggtagcgttttgactccattcttggcttgcttctttttctttccagaaggatttttgtgcagaaatgggtcttttgttgccgtgttagtcctccttggaaagcagctcagaaggcccgtgaaatgtcgggggacaggacccccagggagggaatcccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatgcttgaatatttttaagttttatacatagtttctaatttttttcccagcagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacagctgcgggggagcccaggcattctttgtaagccctcctgactacctgactcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctccccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccgcagctcactggggagcctgacagtggggccatgcgcctgacactcctctctgcttgtggacctggcaaggcagggagcagaaaacagagccccttgaaggcttcctgtctgcgtctgtgtgcagtgtggatttagttgtgctttttacttgctgggagagcacagccaccatttacaagcagtgtcaccctcgtgggtggcgaggacagaacaggagcctctgctctctgtacctatctgggcccggtgggctcccttgtcctggcttccatctctgtctcagcgaccattcagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcaaaggcctagatgccagtgtgacctcccacaaggcgtggcttccagactccccggccggaagtgatccttttttgccgcgggccctgagtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaaccccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacgtggaggattcctgccacacagcctgggcccggtttcttacctgtggccaccgctctggcacgagcccctcagtcttgggtggtttctgcctggtccgggatttggtgttcctgctgagtccagcctttctgccacctccgcatgggccgtgggtggtgttgtcagctgcctcccaccttggcttcagtagctcacccagctcacaggggagctgccctgggctggagatgggcatgcaccctgggtcctacttgaatgaatgcagcttgaggagagccggccatatacactgggccacaggttaccctcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcccctgcctgcagtgtgacccttctcagcttctctcagcagccctgcctgcggagtgtcaccgccaccatgatcatttccctgacactgcgagggtgtggggacgtcctgggtagagacagggcccgtggcagcagcaggctcaggggcgccctacactggtgggctggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcaggtgaggaaagggctgccgctggcccgtttctgagtgttcagcacctaaggatgacagcactgtctgtccctaccctccgggtcctgtttgaaaatcaaacccatgctcacaggccaatttttttttcttttagagacagggtctcactttgtcacccaagctggagtgcagtggtgcgattatagctcaatgcagcctccaattcccggactcaagggaccttcctgcctcagcctgccaagtagcttggactatagctgtgtgttttcttattattttgtagacatggggtctggctatgttgtccaggctattctcaaaattcccggcctcaagcaatcctcccgcctcggcctctcaaaggttgggattacaggtgtgaggcaaggcacccagctcagccacagagccctattgcatctctcttactaggagcaagagctgactgccccctcatccccattccagagtgttggggctgtgttcagccgaggccgggccactggcatggcccagggagcgggatcattcactgctgccccaaatctgagatcattccaccttgacaagacttcctcatccaatccctttacttgacagctggggaaaccaatgcgcacagagcacccccagctcactcggggtctcagagctgatccatgagcggaggctgagatcctgggatcttgtcccccagcctccctgcaaccttaatcccgttctgctgaaagagatggggccggacctcgaccagcagccctggcctggacatgactgtgctcatgcaggtattgaggccgagatgccccggcatcatatgtttttctattttcttttttttttttttgagacggtgtctcactctgtcacccaagctggagtgcagtggcatgatattggctcactgcaacctctgcctcccggttaaagtgattctcctgcctcagccttccaagtagctgggcctacaggcttgtaccaccacacctgactaatttgtgcatttttactagagacggggtttccccatgttggccaggctcgtgtcgaactcctgacctcaagtgatccacctgccttggcctcccaaagtgccaggattacaggcatgagccatggcgtcacttaaatgtagtgagaggccgggcacagtggctcatgcctgtaatcccagtactttgagaggacgaggctgtcagatcacctaaggtcaggagttcgagaccagcctggccaacatggtgaaaccgtgtctctaaaaaaaaatagaaaaaaatagccctgcatggtggtgagtacctgtagtcccagttactcaggaggctgaggcatgagaatcgcttaaacctcggaggcggaggctgcagtgagctgagatggcgccactgcactccagcctgggtgacagagcaagactttgtctctaaataattaaataaataaatatggctgagcatggtgccttaggcctgtaatcccaacactttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcacttgaaactggaagtcagaggttgcagggagccgagattgcaccactgcactctagcctgggcgatggagaaagactccatctcaaataaataaattaataaatacagagcaagattccatcttaaataaataaataaataaacatacacctgtaatcctagcagttcgggaggctaagacaggtcgatcacctgaggtcaggagttcgagaccagcctgaccaatatggcaaaactccatctctactaaaaatacaaaaattagccaggcgttttgatgtgtgcctgtagtcccagctacttgggaggctgagacaggagaattgcttgaacccaagaggtggaggttgcagtgagccgagatctcggctgcacttcagcctgggtgacagagtgagactgtctcaaaaggaataaaaaaaatacaaaataaaaaaaatgtagtaagatggcagagtcgtgccgcggaagcgtgctggtcctatccatgtagtgaaggctgatttcatacagaaatgtcacaagaactttttttctttttctttttttttgagacggagtctcgctctgtcacccaggctggagtgcagtggcgcgatctcagctcactgcaagctctgcctcccgggtttatgccgttctcctgcctcagcctcccaagtagctgggactacaggcctgtgcagcagatgcaggggggccactaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggcctggtcctcaacctgcagtgcactgttgatgcactggaatgccgcctccttctcccagtccaggtcttcagcagtgacccggtaccccagctctaagggaggtggcagcatcaaaggctcccctcgcctgcgtggcagcaggggaaacttgcatctacggggcctagaggcctgggatatgggggagccacccctgggagcgagtgtctgccctggtgctgtatctgccgtcttttcacactgggtgtgacccgaagagacagcctgaggtccgtcctcactcactgtgtttgaggaactgagggtcagctggcagtgggatgaggctggcccctcttccactttcgttccgggaggcctcccgtagagctgtaggggctcgagatggcatttcatttggggcacgagctggtccgggaggtctgcgatctctggttctgacctctgggcacctgctgcagctgtggctgaggcccagaaatgtgaagggcctccatccactccagtagtgaccccaacgtggggttcaatgcggaggggggaggggctgctgcggcagctgcaggagcagaagtgccacgccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacctctgcagcagatgctaagggggccagtaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggccttgtcctcaacttgcagtgcactgttgatgcgctggaatgccgcctccttctcccggtcaaggtcttcaacagtgacccggtaccccagctctaagggaggtggcagcatcaaaggctcccctcgcctgcatggcagcaggggaaacttgtgtgtactgggcctagaggcctcggatgtggaggagtcattcctgagggtgagtgtctgccctggtgctatatctgctgccttttcacactgggtgtgacctgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcaggagctcgtccaggaggtctgggatgtctggttatatctgatttctgacctctgggcatggaggtctgtctgcagaggcccgggcccgggcacaaagggagagaggcctccattgtcccgcaggggccgaaatgcagacggtgcatccccggtgacctccgggacccttctctgatcaccaggattctcttggactctagggtccttgtcctgctcaggcatccctgccccgctctccttgagggccctcaacactatcttccctggacacaagtctggggacagccgggtgttgtggaccccaaaggggtgactcccggctcctgggccccacagagagtccatgttctcagtgcagtggctgagctggaggacgccctggaactcggagcacacagcactggcttgctgtggtacctgtgcaatcaaattgaaggcaggatcccaggaaggaacgcagcgcttgcaggatcaccgaaaaccttcttagagttgtcttgacaccactgatgtcaagtgtctgggtacttgtaggatggcctgccactcagtgcacgggcaggagcaacggggagatcccacaggcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagtttcttctgttgccgggcaacgcgccttttaaacctgagggagcgggcgcgtgagcacatcacggcgcccgtgacagagccagcttaacggattaataagcgcagccaggtacccgcgcgaggcacttgctggcaatggcgggaggcggacgtggggggtcatgcaataggtactggaaggagagaggcgggcacaaaggtcgcgggaggaacaggtgcccacaatggcggcagatctgcccgtggatcactgaagattcctgctctcctgctgaggtggagattgcagtgagctgagatcgcaccattgcactccagcctgggcaacagagtcagactctctctttttttttttttttttttttttttgagatggagtctccctctgtcgcccaggctggattccagtggcctgatctctgggctcaccgcaagctccgcctaccgggttcacgccattctcctgcctcagcctctggagtagttgggactacaggcgcccgccaccacacccggctaattttttgtatttttagtagagacggggtttcaccgtgttagccaggatgatctccatctcctgacgtcatgatccgccctcccaaagtgctggcattacaggcctcggcctcccaaagtgctgggattacaggcgtgagccaccgcgcccggtgttgaaactcccttgaggcattttcttcggccttcgggtccatcctctgtctcctccttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctcttcaggtctgatgaagtatccaaaatcaagctcctgaccatcctcaaacctgccccttctgcagggtttacctcgctagtcggcgccatccttgattcttctctttctcccacccaggccatcatctcttgcctggttgatacccacagcctcccctttgggctttatccttatccccgtcatagctgccagagggaccctgtgaaaacactccccagcctgctcattcttctgccctaagcctgcatggcacagagcaaaagccagttgttatgggacctaggaggtcctgtgggatgggccccagcctgcatcttcatcctcttctccccaccccactccattcactctctgcctatcgctcaccagcctataccacctgcctcagggcctttgcactgaccatttaggcaacattccaggctcttttcacacgttgcctcctctgagaagccctccctgaccactctgcccatacctcatgcctcttgattccccttacctggcttgtggtttcagcactttccctgtgtgtgtttgtttttcttggcatgagggcaggacctaagtgtctgttccctgttgattccccagttccaggcatgcagtgcaaattctagaaatattttttgcatgaaggaatgagtgattgaatgcagcaagggtctggaggctgaggaccaggcagacagacattcagagttgctggaatgcgacagagacagggagtcagactggtcatgcaagatcctgggcctgcccttgggtcctggggagccacggaaggttgtgggtgccagagggttgtggtcagagccacagtcaggggccttctgagacctgtgtcccctccccaccctccctccccacctcctcaggccagctctggggtctcggcaggtggtccacaacatgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcaggtgctgtctgacctggctgggcggtagctttggctccaaggtccgctccccggtcagcgagatcctgttcaatgatgaaatggatgacttcagctctcccaacatcaccaacgagtttggggtgcccccctcacctgccaatttcatccagccaggtatggggtggaggtctggggatgggggactggggtggagaggggcgggtgtcctgggcaggcagctgacgggcatccctgtcttctcccatcggccacagggaagcagccgctctcgtcaatgtgcccgacgatcatggtgggccaggacggccaggtccggatggtggtgggagctgctgggggcacacagatcaccacagccactgcactgatatgtgtcaccccttttctccctggccgtgcccaccctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggtgggccgggggttggagaaactgagtcacggtgtggggccccagggcatcctgggctggaggcctggatcatcacagagtggacaattgttggtgtcctctctctagtgcctgggccatctggagcccctgtgccatgagggccaagccccctgctccagtgagacccagcaggccccaacctgctcttcctgatgacctggcccgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtctccccactctctgggcctcagtgtattgtgtgtgaaatggagccatctgactggggaggaacagagaggtgggattcggagatcttcacaatgcggacactggaactagcctcagcatcttcagcatggggagagccaggcacatggctgggggccaggggaaggttcacaccaagccctgcccctttccaccctgatccctcggactttggggccaggccctcccttactggggctgggcagtgacactacctaggatcagccaccagggggtgccacgaccctggcactttcttaggcagagggtggccagctgatgctgggaacccgggcgccttctcagacccgtaggcgtccagctcaccctgccgatgacactggaggtgaagctgaggtccgaggaatggggactgggcaacaggctggaggaaaacatctcggtcagagccacgcccctggggggtttccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccagaaggaaacagctagacacagcagccttcaccatccgcagcccctccaggcctccctcggggcctgctccctcctctgtgcacagttccaacacctggggcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacaggtttttatgcctgtggagtcaagtcccactgggtctgagctctgcagggctgtgtctctggggctctgcaggggtgagatggaggtgggctcaaatggtgtacaagtcactcctcaatccttattttatttatttaatttttttaaaaaaaatttaaaccaatagagatggggactcactatgttgaccaggctggtcttaactcctgacttcaagcagtccccccatctcagtctcccaaaatgctaaaattacaggggtgagccagtgcacccagcctcaatccttattttggcctgagaggaaaggccgtggccccatttgcaggggagaagactgaagctggaggggcaggccttgctctgggttgcacagcagcaagagaagtgggagctggccacgaggcttcctcgactcgacacactggtggggtacaccctggttctccaggtcccatggggctcagcccaggactacctcggggggtgaggtacttaaatcctctccttcattctcatcgccctttcccccatcatttcctgaggaagaacattcagggacctgaaggggtggcctgcccctccacatctgtgggtgtttctcatcaggtgggacaagagactgagaaaagaaagagacacagagacaaagtatagagaaagaaaagtgggcccaggggacctgcgctcagcatacggaggccccacgctggcaccagtctctgagttccctagtatttattgatcattatctctaccatctcagagagggggatgtggcaggacaatatggtaatagtggggagagggtcagcaggaaaacatgtgaacaaatgtctctgtgtcataaacaaggttaagaaaaaggtgctgtgctttgatgtgcatatacataaacatctcaatgcattaaagagcagtattgccaccagcatgtcccacctccagccctaaggcagttttctcctatctcagtagatggaatatacaattgggttttacaccgagacattcctttgcccagggacgatcaggagagagatgccttcctcttatctcaactgcaaagaggccttccttcctcttatactaatcctcctcagcacagaccctttacgggtgtcgggctgggggacggtcaggtctttcccttcccacgaggccatatttcagactgtcacatggagagaaaccttggacaatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctccggtggtccctgcaccctggcctctgcctgacgaggatggtggggagaggaggggggacgtcccccacactgctgtctccactgttcctgctgcccaggcctctgggcttccaggactacagcgggtgggtgggtgggctggcctgagcccaggaatgcacttcagttcctggttgagcaatgtcactgaggcttgggagtcgggtgggggcgggaggaggcgtccacaggccccccctaccgtgagaggcagccgtgggaacagcctacctctaaacaatcactgcagcccaggctgaccaggggctctggccggacataggggcctggcaggctgtgtgccctgtaaggacacagtctgtctctgtgcctcagtttctctgctgcccagatggaggggcccagactccaggtgtacacatctggagcaggcagtgttcagttggggaggaagcggggaggactgtgggggccatgtgggaaggattccaccccacatcacctgcacccctgctgagcctggtcaacggagcccctcagtgggtcctcactctcctggctgcctcccatttaggcaccctgaggcctggggagaacagagccaggccagtgtccctagagaggctgcgctgccagcacagtagtagcggatttggattcagggaagcagacctgcagccagggtgggaaagagctgcaggcggggtggagcccccacatggcacagcccccctccctggaggtccatgctgcatttccaggacagcaagtcccagggatggatggtgcctggtgccaagggctagaggcatggtctgtctgcattccctacaggggcatcttgtagtcaccagcatttgatgctgtcaagtccccctgtcctctgtgcagactgggaagcccttggtcaccctggggggtggggggacccaggccaggctgcagaagcataaggacttgaacccgggtcctgagtgacaccaccttgggtcctcctccctctgcctctgttcagctccaccttgatgctgactaggctgggccatgcggagagggttaggggatagagatgagagctggggagcagggctccactctgggaggggggcagccttgcgggatccagggcagagttaagcggccccagctccgctttcctagagctgctgagaacccgggaaatggtgtggaggttccggggagccctgcccctacctggcaaccgcagtgcaacaggcaccaagttctcctgcacattgcgacagtgggaccctgggctctggcgggcggtaggtggggcctttggacctaccagcagtgagggagttaacacagcagctgacttctctaggcaaggaaaactcccctcagacgctttgctgcctggcctcctgccagcaacaagcaggagctgaaaactagaagctgaggcatgagtttggtcactccgtagtgtgcacttggtgagggcagcagctggccacagctgccagccgtctgtccattcgcccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccgtctgcccaccggcctcccctctccttctgggccgcagagccacggcccaggactgcagagccatggttggcctggtcctgctggggctggggctggcgctggctgtcattgtgctggctgtggtcctctctcgacaccaggccccatttgacccccggcctttgcccacgccgctgttgctgctgactccaaggtctgctcggatattggacagtgagtgagatgtgggaggaagctgggtggcccttggcagccagcccctcctggagaaggcgtgtgtgtgtaagcgtgtgtgtgtgtgagagattatgtgtgtgtgtgtgggtatgtgagtgtgagtgtggggtgtgggtgtgtgtaaatgtgtgtgatcgtgtttgggtgtgtgtatgtgtgagtgtgtgggtgtgtgggggtatgtgagtgtgagtgtgtggggggtgtgggggggtgtgaatgtgtgtgattgtgttttgctgtgtgagagtgtgtgtgactatgagtgtgtgagtgtgtgttggtgtgtgggtgtgtgtaaatgtgtgtgattgtgtgtgtgagtgtatgtgtgggtgtttgtgggtgtgtgtgagtgtgtgagtgtgagtatgggggtgtgggtgtgtgtgaatgtgtgtgattgtgtgtgggtatgtgtatgtgtgggtgtgtgtgtgcatgtgtgtgtgtgtgcgcgcacgtgcactggcccaggaagcaggagccgtgtgtgtgggcttcagcacctgcaggacttgagcgcaaggagacagcctcagggcccttgcacagaacaggtggcagggtgtgcccgtggggcagatggggacttggggacaatggtggtgtgtgagtccatacctggctccaggattcaggaggcccatttgcatatcccaggtgggaacctgtctggccccggctgaccctgctggccggtgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacatacaggatgccccttcctgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgctcattcattcaccttttcattcattccttcttccctccattcccccatctgtccatccttccctgccctgattgctcatgccaccccccctccagcccctcctgacctggtcctttggtttctcttcagggctttctgtctcctcccacagggctgagaatggcagctcagggacaagtgggggctggggactgcttagtctccccagtggctctcaggggatttgagggtttgacgccagctgccaccccaggctgtgcccctcctctgctcaggaggacatgcagagatgcgacacccacttaaactcgaagttgcaaagatgcaaatgagactggggtctcaggcaccagagaccacccatgggcacgtggcttttgggagtggggacctgctgccacagatctctgaagagtctggacctgctgggtctccccgagtgactgtctgggggtctccatagcatgccctgctgtgtgcgcgacggtcactggttgggtaggggtctctactctaaagctccctctgccggcatcccctcgaactctcccttggtgaagagaggatgtggttttcccccagtgttttatcaaacaactctctccacttcctgttttaagaagctgggagtggaagagagcctggggctggccccagctgctgctgcgaaacaggggtcactggacgctgggaccctggccgggctggctggaggcctcaggaagaggcctgctacagtgtcatcctggccaagattcctccctgcagaggaccctggccacactgccacagggtctgctggggccaccagaagcccatgctcctgcctccatctctcccctttgtgctcacctctcaccaggaggccctcccagagttcagtctcctgcttttctttttttttttttttgagatggtgtctcgctctgtcaccaggctggagtgcagtggtgcgacctcagctcactgcaacctctgcttcgttggttcaaatgattctcctgcctcagcctcctgagtagctgggactacaggtgccagccaccacgcccagctaatttttgtatttttagtagagacggggtttcaccatgttggccaggatggtctctatctcttgattcgcccgccttggcctcccaaagtgctggcattacaggagtgagtcatggcacccggcctcatctcctactctttcagcaccaggttttattcttgggattctgctacagccgcagcccctgggtgcgagctcctaagctttctgcgagtgtggacccagcaccgtgcctagtagacatacaaaaggaacatggtgacagtgaggtctgtcatctccagcataatgactcttttgatccttgtaaaaaaggtgatttttggctgggtgtggtggctcacacctgtaatcccagcactttgggaggctgaggggggtggctcacttgaagtcaggagttggagaccagcctgggcaacatggtgaaaccacgttctcctgggtgtccaggtggtccaagaccccatgactatatcatgacaggaaagagagagttaataaatctgagggcataaaatgtgaacatatactgtttccatcccacatgaaggcacatgtgtctgagcctactctctgggaggaatagagatctcagtttccacatcagggttgcattctatgcacctgcagccatgttattctgctgtagcagatgctacacttggcaccgacattgcagatgggaccatgaccttactggagttgtagaaatctactttcaccttccagaatccatttaatgtttataggagctagtccaagaaattagatggaaataaagtcctgctacaacctgagaatctttaggcctttaaaggtaacactattacatgcaactcccaatgaagggtgaagcatgattattatttaccttttttgatggggtgaaatggggagagagtcggaattcatcacatacataaaaggcaggtcgtataaatgttagtgtttgtgagtcacaaggtctgtcttgcagcgactcagatctgcacttgtggcatgaaagcagccattgactgaacataaatgaagggatatgggtttgtttaatgaaactttatgtacaaacgtaggtagtcactatggtttgctgaccccagcttttccattgccccatggaactttctttgggatgcctttttgcagtgggttctaggtgagaaaaattggctcggatctggatgctgaagttgagactggtgctgtcatgtggctactgccctcgtccatcctgggtgacttctgactgttgtgatgagcagggccctttgtggctgcctagctcctggtgccaagaatgatgaaccctctgcattgccctctgcaaagcagaccacaggacagccaccctgaattgctcgttctcactgtgtccaccttgcctaagatggttgggcacattcactggctggttaattccagatagtgttatctcattaatgccaggcagtaccttctagaagaggctcctaccatctgcactagactatggagcttctccggggtgctagtgctctgtcacctgaatatgcttcagggatttgctaaacagaatgtccttcaggccctcccatagaacacagggaaacattttgttttcccttgtgtgactgcaaaagggaaaacaaaaataagcctgggaaagggtgatttaggactttgatgatgtcgaggctgggaactcccatcagagtttctatatatgatggggaggggccaattttttgaaagtcagcattgactggccattggacacaggtggccctacattgactctctcttgcccaggacctctcctcaaaaagtctcaggtgattcagccccacagcagcaggggcacgacaccttctgtcctgaaggctgataaccggtgatgtggacagctgccattcactctggggaagatgctgcctaattccacacccaccgcctgcatgtctagtgagagcctgcctattcctatggggacaccccaaaattagctccaccaagaagcctcctccacctccattctccacagaagacactcatcttatatgcttggctacaggtcctgtttgctctgctattatccctatcacctgtccctgtctgttcaattgtctcacatgagcagagagacgatgtctcattcagccttatttcccatgggtattaataaatattcattgagtcaattaaaaattcatgtaataacctatcaatgcatgtctctgtgtgaggtaaagaaagcatcctgattgtaaatataactctcatgttaaaagctgggagcagtggctcatacctgtaataccagcactttgggaggctgaggagggtgaattacctgaagtcaggagtttgagaccagcctgatcaatatggtgaaaccccatctctactaaaaatacaaaaattagcagggcatggtggcgtgtgcttgtaatcccagctactcgggaggctgaaacaggagaatcacttgaacctgggaggcgaaggttgcagtgaaccgagatcatgccactgcactcctgcctgggtaacagagcaagactccgtctcaaaacaaacaaacaaaagcattcttacagattatcttggcttttattcctttattctaccaataagttgttagcctctcttatgtgccatttgttacaaaaaatcagctgtcatttttatggagactgagaagtcccctgatctgtccattgtaagctgaagacccagtagggccggttttatggattagtccaagccccaaggcttgagaaccaggggagccactggtctaagactcagtccaagggaaggagaggatcaaggtcccactcatgcagtcacacacaaaggaggaattctccctgctggtgccttttgttgtatccacgccttcagtagatttgatgatgccaaccacacagaggagggcaaagtactaacttagtccaggcattcaaacatgaatctcatctggaaacaccctcatagacacactcagaaatagtgttcaatctgggcacctcatggcctagtccatttgacccataaaacttaccattactatcattaaaatggcatacgttatgtatattttgttaccataaaaaatttacattctgaaaataaagtacagtgtcttagctcatttgtgctgctacaacagaatacttgaggttgagtgatttacaaagaacagacagttatttctcacagttgtggaggctgggcagtccaagatcctggtgagggcttttatactgcattctcatgtggcaaaggcagaagggctggagaaagctaaaggctgcatgaagcctctttcctaagggccttaatcctctcaagagtgaggagctgtcatgccctaattgcctcttaaaggccatctcttttaacactaccacactggcaacatctgaattttggagaggacacattcaaactatagtagcaagtttaatttggaaataattctactcaaaaaagcattagaattgagtaatgaaaccctgtatatcccctccctggatgcaacaatggggtacgttgagtccaatccagggagcattctcgcttcctctctctactccatcttaaaaaattaacaataattttctgtccactccataatcccatttcaccaattgcccaaaatacctacagtagttatttaattatgtttactaacagaatcctcaagattccaacccttatatttgatttttacttctctctgatcgatctggcatttatcgacgaagattccatcaaaccctgggcttatgaaaaattttgcaaaaattccacagataggaaagtgttcattgtgtgcagcagaaaaatgttcatcatgcagagtggaaacatgtttatgtgtggcaagcaatggtaaagtgagtcctgcattttaaaatgaaaggacagtagatggaaattagaggtcacactgtgaaataatgaattctgttaaaggcaacaacataggttagtataaaaggcagcattatggtatttttggttagtaacttctctttggaaacctatcacaagcagagagactgaatccataattaaaaccttccagccaaagaaagtccaggaccagatggcctccatgttttttatatcagccatttaaagaattagcatcaattcttatcaaactctgaaaaactagaagaggaagaaactattcctaacgagcccaacatgaccctgaccgaagtcagttaaagaccctacaagatgtgacaactaaagaccaatatacctcgtgaatataggtgcaaacatcctcaaaatgtgtgccagcaacatgaatccaacagcatattcaaaagattatgtcatataactaagtgagattaatatcaggaatgtaaggagggttcaatataagaaaatgaatcaatggaatatacaacattaatagctcaagagagaaaatacatattccaaataacatagaacaacaaaatccaacaccttctctaaatgaaaaaaaaaaagcacccagaaaactagaagtagaaggaaacaacctctgtgtgataaaaggcgtttgtaaaaatcccacaacaaacttcatactcaataatggaagaccgaaagctatccctctgacatctccggatgcctaaccttatttaagtgagttcagcaaagttgcaagatgcaagatcaccatgcaaaactcattcatatttttttttggggggggatggaatcttgctctgttgcccaggctggagtgcagtggctcaatttcggctcacctcaagctccgcctcccgggttcacaccattctcctgcctcagcctcccgaatagctggaactacaggcgcctgccaccaagcccagctaattttttgtattttttagtagagacggggtttcaccgtgttagccaggatggtctcaatctcctgacgtcatgatccacctgcctcggcctcccaaagtgctgggattacaggcagagccaccatgcccagcaactcattcatattttatatgcaccagcaatgaacatctgaaaaagaagttttaaaagtaactctatttacaagaccaccaaaaagaatacaaataaatttatccaagaagatgaacttcttgtacactgaaaatgtcaagacatttctgaatgaaatgtgcagagatgcctcaggtggctcctgcatattccgcccctggtgaagcatgtttgcattttcttgggaactgagcacctcctgcttggtcgtaaggcagacaggccacacagagaagaataattcctccctttgggccagcagttcagggatcaagaaatcctagacctgaggagtaatttctgaatctacacctagaccaaggtggtgtctgagcctccagcagtcagtgaagagcaaccagcagtggtcaacagagagtcacatggcaaagccgcctggagctgggctggacctgcatgtcagggagatgctgacatgcagggagggtcagtgaccatgacctaacactggggggaaaaatgtccttctttttctagagtatcatcgttaacattgatgtacaaactcttttgccccatgtctcttacatctggctcttttagaatttgcttatttcacagcaacaagttcaagtcttatactacattgcatcccagcccacccaattatgctaaaactctggatctgtcaaacactttcagagcagcagatttgtacctggccctaaacgcatagtggggacactgaggcacagctcctagggccttcccctgaagctccaccaagggcaaaaacttatacaagcttcatggatattaaaaacctccatgttcacttagcaagggagaaattttattcaagttctgcagctcaggagctgtgctcaagagcaagacccagaacttctcaaagcctggttttggcacctgtagaatggagcccaaaaacgcagacagacttacctcggagctctatagggccaggacagcccaggagtaaagccagtttgagacacaatttggggtgaagatgtcggcccagaatagaaccaggagaggaagaagaaacccgtgtgctgagagtgggtctgctgggaccactcctctccttcctgggccctttggggctgagcccttctctaaaaaccacagagctactccagcagcagcccctgactctgctgatttgcatcatggccgctttatccagcaaggggataagagaggcctgggaggaacctgctcagcctgggtcttgggaagcagcatcgggggtgcctcagccatggcctggacccctttcctcctcggcctcctccctcactgcacaggtgctgcccccagggtctcactcacttgcccagccccaggcctctgggtccagcctggccctaacactgagctcagtagggccctacctgtggtgggcaggatgctcatgaacctgccgcagggcagggggctggtggggcagaaatccccccacactgtgctcctgttctcttggtgccctaagggcacttttattcctggggctcaggtcagttcaggcaagtggcaagatattctttggttaatccccagagtttcaggccttttcgctcctcttttctctccttgcaggctctgtggcctcatatgtgctgacacagccaccctcagtgtcagtggccccaggacagacacccaggatcacctgtaggggaaataatattggaattaaacctgcttaatggtaccagcagaaaccaggccaggcccttgtgcaggtcatctatggggatagcagatggccttcagggatctctaagtgattctccagctccaactcggggaacatggtcaccctgaccatcagtggagcccaggctggggacgaggctttcctctcaggtgtggggcagtggcactgcacacagtgacagaggcagacaaggaagtaagacacagaccccttccccatctgtgctgctgtcgtcctccagcccggcaacactgtggacaaagccatgagcatgcatgacccagttcacctggatctgagacccccagtctttacttccttcagccctccaggcaggctgtgcagagggggcatccagaatggatttagggctgaggtgaccaggatgtattggggttttgtggactccactgtgattcagggaaattagatcttccaagcagaccaaggtcaatatcctcagttatctctggatttccataggtggtgataggccagtccttggccgaaatgtcctgaatcagtccccagaactgcccagctgaggctcctgtcattctctacagaaaaactagtggagtggacactgtgggatcctcccagatcccctcttatgagctcacccacacagcactcctgggagcttctggcagctcagagctgttcggtgcagaaatctgcctcccccaggtttatgtctcttctcagggaggtttggtttcatgactgcctgtggccaaggtctcaagactcttcctcagtataacaggacctgaaaatcctccaagatccatagctccttgtagggctgactgaagcctcaatatgtgtcagggcctccttctgcctggtgttgcctccatcactttcttaatcatctgtgtatgatattctccatctcagagtctgtttccagggaacccaaactaagatcaccagccatccccaacacgggccatgagggagctgaagaggccactgtacactagaaagcatcagtttactcttaaattaccactgcgagtctgcaaatgcccagcgagacctgagtggttttttttttcatttgtgtgaaatgaaaagggagactgacatgccagatgctctgggttctgagggagagttggagtcagatcctcctgcaggaatccaggggcagcaggagcagcctcgccccatgcagggaccacagatgcacccagagggtgagctgcaggatggacactgcccacctccaatctgtatatcctgtgcaaaaaaatcattgttttcaccccttcttcagcctatcaaagttgtcacttaaaaagccactacatctcatcctgtgaacaggaaacccatccacatctccatcagccacataatctccacataaagattcttcaaaaaatagtaataatagctgtgaaaaagtatctaaaatattgcatgacaatcatacttagattacatatgaaaatggcactatttttgatatgctaggtaaataaaatatattatttgaagtcatttaccttcttctctttatatgtctaatgtggtgactagactagcctagtgggattcccattaggctcatcatactgtgattgaacagtgctggtctgcacctcttcaggttaacaggggctgtggagtgacctggtgcaggaaatatcatctccatccataggatatcagtgtgaacccagggagaggcactggtgcaagagagatgagaacaggggtgtggagtaggggactgagccttcactttgagccgaagaagtttcctttcctatcctcaatcctgaacaagagggatttctggacttctttttgttttcaagtttgtgccccttcagatttggggctgtctggaatcctgccaggggacaccgagaaaaaataggagtctcacactgactgttgtatttcatctgctggggccatcccaaaccactgcgtacaatttcctttcctggtgctcaaatagctgctccacgcacttgttgtggtttcagagatgaatctgggtgggaagacaggacagtgtatgttataatatttaaatggaacccaaatccattaatatttattttaatatggaacattaaaagagttttgtaataggcaatgggaaaaggtaaaaaagataaaagctttttgagaaaaaaaacaaaaacaaacttatagaatgtctatgtgtcttcagtgttgcagggttgagagagatcagctttatggtgccccatggatgtgctgagatggggaaaatcaagaaagaaggaagtatgtaccactgtgactcaacaaataaatcaaagtaaaatggacttaaatctttcaataagtcattcacaataaatatcactctggtgcacacagaaatgcctgttagcaaactttcccttccccctggccatgtctccatggatcacctgtgtgcagagtggctccggtcagtgctctgtgttccctccacagggctccccacaacatgtgccctgtgtggatgtgggtgcatcgcctggggtggctgatgtgctccagggattcgatgctgcagatgcctcagcaccaagggtgggggtgggaatgggacaaggctgcagctggggagaccaaggatcaaccacacacagcaggggtttccacggggtgagcagcctcatttcctgacagtagagcgagcctaaaggtaggtgccaggcagtggtatctgtggggtggcccaggcctggagggtcacagagacacaggcaccacacagcagagacactgagggccaggagctcactcaggtgagggacttcagcagatctttctctcctggtacaaagagatcaagttcctaccatcagaatagacaaacaaggactttaatctcctcagctgagccccactgtccagggaagaagtctctgagcccaggcccaggtgagagtgggatgaggagaggagccaggacacagattttcatggatgccccgccctcctctgaggcagagcggataagacagggctgggggcatacccagtgcttgagtctcaggaggcagcgctctcgggacgtctccaccatggcctgggctctgctcctcctcaccctcctcactcagggcacaggtgatgcctccaggaaaggggcctcagggacctctgggctgattcttagtctcctgctcctcaggctcacctgggcccagcactgactcactagagtgtgttttttcctttttccgggctctcgggctcagtctgccctgactcagcctcactcagtacccgggtctcctggacagtcggtcaccatctcctgcactggaaccagcagtgacgttgggcattataactatgtctcctggtgccagcagcacccaggcacatgatttatgaagtcagttataggctctctggagtctctgatcacttctctggctcccagctctggcaacatggcctccatgaccatctctgggctccaggctgaggacgaggctgattattactgcagttcatatacaagcagcaacattttccacagtggacataagattgattctcaggctccaagtctggccagtgagcttctttgagactccctgggatcccagcagtgacactgatcactattgctgtcccacacatcccaagtgatgaggaagtaagaccaaaaccctcctgagattcctgacttgtgtcctgacaccagggctgttgggattcctgtctttccttcaagattgttcaaataagcagtgacagtcacttccatgtgagatatgagaagaagaataattccatatgaaccaaatccacgaagcctacactgaagcctgccaagttctctgcagtccagcgcgatgaagggagcattttcgtgggaacttttgggaatatgaggggagccaggctcagctatgggttccagagacaaagctcctggatgtttctccccggccttggtccatcacctgctacctctcctcactctttccacagacactgccccaggctaagcccccacaggaccctaagcctattcctgaccctgagctcagcccaggtgatgcttcaggagatgggatcctgagaatgagccccaacatctctttaacctaaggtgtggggtcatgagacacctgttagccataagacacctgtcccccacctgctcaggagacagtggagcaggcaacagtgcagagagaaccagcaggagccaggccaggccctgcatccaaagcaggccccagtccccacagattctccagctctagcctgtggtacagcccccactttctgcaggctgaaatgggcttctcaggatgggcaggccatgatgggggatggcagtgtgtccacaggacacagccctgctgcctgcctgaccctcatgccccctccttccccaccctggttaatctccaccagaaagggcccaggttcagaactcaggacacctggatcagctcctggacttgcccccactgctctctgttctcctgagccacttagtctcttttggcctcagtgttacctgctgtgaagtgaggaggcttatactgaactgaggaagctcttttcttcattcaaaattaaaagacagaaaaacaatgaaagtcatgtaaattaaagcctgctgaggggatgtcatttaatgggcttcagtgggtttcagacgtggaacttcttgtcttttctctgcagggattccaagacaggggctcaaaagagcttgctttctgtatggtgggaacagcggtccctagctgagaataagcaggagattcccagcttcatcaggaaggcagactaggctagtgtagaaatcctctccgtacaaactctgagaggtgttgaataaaataaagataaacataatttcatgttttcatggtgccgatgatggtgatgttagctcacaactaagctgcagtgcctggaacatcaggaaatcacagtgaatcacagctgctcttattgggtgggaggtgcaccagtttgatgcctaagtacatagaaagcctgggtccctgtaggatggcacatgcatctctctggactttgaaagctttgcagaagagcttcagttgactcactctaattagtccggactgaacaaaaccactagaggagggcatttcaaccctgagacacttctatagccccaacttcctaccctgcgtgtgcgaactctctgtgctgggctgggcagggcagattgggtcaccctgcacagaatggggctggactgtctggtcctcaacttctgaggtgacaggtgctgtggaggcacgtggaagaaaaaagctcctgggctgagtctcctccaccagctgggggcagcagagctgcagccaggagcagtcaggattaaggctggggctgcccagctggggcaaagagaaggccagcctggcgttcaacaggtgtccaagaatcagtcttcagactgaaagtgagtgcagttcatcctatcccctcaggctgcagtgaccattctctgagggtcagactcatacagtgtcaccccaggacactgacagaagcccggcacagtgaaggcctcacctgggaaatgcagctggaggaggctgggaccaggtgtcaactggggcagcttactcaggaaggggatttctttggagacatcccaaggttgaggtgctctaggagggggcacagcgtgaggtgacggggctcccagggcccgggttcttcacccaggatggctgtctgagcctcctgccactctcagggccttgtccctctcagtccagcagcaacctggggagctgagccctctgtcctgggcacttccagatacaccatacctcacttccttctgcctcaccttccagctccaggcggactctgactcagggggaaactcctgtgctcaggggagtctcgggtgggtggggtgaagcatttgggatcctgatcccttcatggggcatccccagcatccttaaggagacactcttcagagggacagggcttctcacctgcctcagctctgaccatggggctgtccacactcagtgacaggacactgaccagggatctgactggagtgaccaggaacctggctggggcaaccagggaccacccaccctctggagctcacatgctgtgcagagaccatgaccctgggaccccttcagagaccatggggcctgaagttagattttcagtccagtgtggttttctcctgctttttgcaagtttacataaaacattgatgagaaaaacatacataaataacagacgagctgagggtgccaattgctaatctcttgtggcaatgaggggtgatgtagcaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctgggccacctgctgctgagtcaggtgtcagcaagatctctccgcagagcccagctcagcccatggccaacctcctggaaggtccacagctctgctgagcctggcccaggacagaccccaggtcagcgaggtttgggacagtggtcatgagattaattcccagaaaggtgactgtgatcacagggcttgaaggctgcagctgattttctaatctgagaccctgcttcttcctcctgttgcctgtgctgccctcacagctggtttgagtgacatctctccaggaggaatcgcagaggatgtaaatttgcataaacgccaaacactgactgcccccaaaagctggagagggaataagagaggcctggggagcccagctgtgctgtaggctcaggaggcagagctctgaatgtctcaccatggcctggatccctctcctgctccccctcctcattctctgcacaggtgctgcccctaggctcagtctccacagaccccaagttgagcctgacctgaatcctgagcaaagccctgccactgcctctgggggggattcctggcaatgcgtcctttgtcctcaagccccctctcctgtcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctcacagtgacacaggcagatggagaaatgagacacaaaccccttgccatctgtgtcaccttcttcctccagccccaggaggactgtggacaaagccacgaacaggtctggcccagtacacccagatcagagactctgaggcctccttccttccagatctctacggaggccctacagaaggtggatcaataataaattcggggttggcaggtccagtaggtcctggtgttttctgggctggagtgtgacttggggaaaaatgacttgaatggaagtacagtcagtgggagacatctattgagtggtgatggtcccagtatttccttgtgtggtgactgaacctagggcagtgccactactctgtggcccaaatgccctgggttattcctctgagttccccgtgtattattgagatgctccagcccccactctcatggtatcctgatctgaagaatcatggccagtgcccattgcagtgtctccatctaggtgccattttcaggactcatgcatccagcatccaaacaaggctgtgtgggagaccgtgacttgtcacagctgttccccactggaaaatgccactgagctgcagagaactgctctcccagtgatgttcccccttcacagtgtggttcaggtgcaatgcctgcctggtccctagattttaatgccatgttttcatttaaaataaccacgaagtgtctcttgctgagcgctccggtgtaacacattcccagtcatgcctctcacaattttctttctgacaaaatttcctgaaaccctattgcaatgaattctccctctcagagtaggattgcagggagttcacaaattaacaaacaaaccaaatactgtctagaagaaagaggatcaaagaggagagagctgcacagggagcgcactctggagtctgcagatattcatgagcaccgatgagcatgtgcatgggaggaaaccttctgtgatagagaaaataaccattcaaagacatttgaggaaacactccatagagctcacacacacatccatgtgcacacacatgcacaatcagaatagtgcctgttcctccgctccatgaagaaaggcccgagttaaagtgggtgagatttaccagtgagaagagctttgcctcagtactggggaaaacattgccctagacaaaaggcatctctggtgttaactaagaaagtgtacggcccctgtgctgatgcccatgtcaaagaccatcacacgtattttaaccaactagcccagagttgtcaccaagagtttgatcttacaataattctgcaatgaacatccctattcagactccttggagttcacctatgaagattaccatagaataaatctctagaagttgaattgttaggtcaaaaagaagtacgtttgtaattttcactgattattctcagattcctattcacgggggggttgtaccaatttacagtgccagccataaatctttgacgtgagtatgctgttgaaagtttgggtttttgccaacatggtagattaaaattttgttgtcttgtaacagtgttattttggatttctcctattctgcttgaggttgaacattttctcaaacatttcagggctcttatattttaggatttagtgagcttttttctaaaatggccaggtaaggagggttttagcccctgtgggccaagagtcaactttgaccatattatgagggaacttataactccagttacaatgtaaccatttaaagctataaaaaccactctcagctctgggaccacacaaaacaggtggcaggccaggggtggccacaggatgtggtttaatggtccctgttttgtagggtcatttgaagtttaaaaatttcaccagcatatattttaggtggagatctttttgtgggtaatactgtatttcaccgcctatagtggcctgagatttctctctagataagaacacacttttcttattttttggatggattttgggtctatctgtgatagccctgtgtcataaactcataacttttgtgtccgtccttttactgtgatttttgggagtgtgacagtatatcaggaatacactatccagggtggaaaatcagagagagggggaggagcaagtgggcaaggaagcttgtaccaaagctggaatatccactgcagcaggctcagagaaaagggtcctaatatcagcatttgactgaagccaaaaccacaagagaccatagaggttctgaggatgacaaataaaaacatagtttaagttttaatgcattcattatttttataatccacaaaaattctaaaactcagaatttaacaatgggataaggaaaagagtttgagatgttaaacgataaagaccccaaggaaagttgccaggaaaagaacaggacctttttggtggaactatgtttatgctgtaaattaccctcttctatatgtctatatatatatttaggtataagagaacatctcatggaacacccttcttcaccacagtcaaagatcaccctcacccaaggagggaaccgaaagggaacgtcaatatgagacagaaaacataatgcacttttgtataaacattaggagagtctctatttgcatatcaaatgtggatgcttaatgttaacattggaaatagtaggttaatatgcatgtgaggtgagttttcttttgactatttctgtctgtgatttatctttcttaatagggacatttctgcccttagaacaacttaacttgtgatattttttgttctattatctgtatcagctctgttttttttttttcaaacagtggcaaagatatcccatgactaatgattaataaattcaattaatgggtatttaaattatttcaagagtggacagttgtgacttccccacatctaactcacagatgtcgctgatgctgactcactcttctcttccaatcatagcaaataaagtgggagctttgacttttctgaagacccagatgacaacaggagagaggaggtgaaaccccctaaagctgttatcctttaaaccctcaggaggaatcatcctggagaaacacccacacttgagttggattatacctaaatgagagtttggtcttagagttggtgctgagttagttcaggatttgggttgttgggatggagtgaatgcgctttacaagtgaaaaatacatgagtttttgggtccataggttggagagttcttggctgaattgtgtcccccagagttcatacaatgaagctctaatgcacggtgtgtgactgaatttggagagaatctttaaagaggtgattcagtgaaaatgaagtcatgagggtgggttcttatcgaatctgactggtgttctcgtgagaagagaaaatttgcacacacaaaaatgagacactcgagatgagcgtgcagaggaaagaccgtgtgaggactcagcaaggaggtagcgacccgcaagccaaggagagaggcctcagtgaaaaccaaacctataaacactttcatcttgactccccagcttcagaactgtgagaaaataagtgtctgctctttaggccagcaggtctttggtatctcattaaggtagcactagcaaatgaaaacaaaagggaccccaaagaccttggatgcgggaggaggaggagatggagcagggtgcaggaggtggggcagggaggggctggaagttcaggctctgaggtcatctcctgggtggaatcctgactccactcactgctgtctggggacttggggaaaaacaattaaccgcccaatattaattccatagtaaagatcgggccttgagcacaggattcctcatcttccttttttatatgatgaaagtcttcttgaggtcatgcttgtaaaacactcagcaatgtatctggcatacactatggtctcagaagtggttattatgaattttctagtgatatgtagaggatgacattggtcctgtgggcagagggggcactgtggaccttggtttgaggactctgaaagacaccaagtccgctggtagtgctcaagagcgaagagcatcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgaggagtagatttgcattcactgctcatcagagagcccacccaacaaggatacaagaataaaagaagtagatttgcatgaagagcctctccttcccatgataagagaggcctgaaggtccctccccagccatgggctcagagacagagctatgtggcatctccaccgtggcctggacccctcccttgctcaccctcctccgtctctgtgctgcctcccagggctcagcccccaaaggaccagagatcagactggccctgagcttcagctcagcacagggagtgatgcagagtgtggggctctgggaatgaccctcatcctcataattaactctcctgtcctctcttgtaggctctgtggcctcctccatgctgactcaggagccagtagggtctgtggccctgggacagtcagccagggtaacctgccagggagaaaacctaagaagccatggtacaaactggcaccagcagaagccaggctaggctcctgtgcaggtcatacatcgacaaaataaccagccctcagggctcccagaccaattctctggctccaagtcaggaacacagccaccctgaccatcactggggctcaggttgaacatgaagctgactattaccatcactcatgggacagcagtgctactcacctcacaatgacacagacagattgggaagtgagatctaaagaccttcactgtctgtgtcaccctcttcctccagccatagcaggactgtggagacagccatgagcagggctggcctgggtcacctgcatcgaagtcctccaagctgcccttccccccagctctccaggtagtctctgcagagaatgagtcaggataggatttggggctggcagaaccaggctgtcctgctgttatttggaatggatgtaccttggctcaagatgacctgagccatcttactggaaggacttactggaaggacggtaagagggagacagctcctgagtgctcatggtcactgaatttcctcctgtgtgttgactgaacccaatgcagtgcctctactctgtggcccaaataccctggattatttttctgaactgcccgtgtttaactgagaccctcaagccccagctttgtgcatcctgatgttctgaacatggaagcctttcacagtgtgcactgtgacatccctcagattcccgtttcaggacttatgcacccaccatcctcccagggctgcagggaggccctggcttctcacagctctccccaccagaaactgccatgcagtacagagaatagctttgctcaaagaattgcccatttcagagtatgtttcgggggcaatgactccctgatgccttaatctgaaagtcatgctttaatttaagaccctgaatatcaaattgaagtgccttctagctgaacactcaattgtaaaacattcccagtcacacactccacacttctttcctgagaatatatcctgaaaccctattgcatggaatcctccctctcagagtaggattccagggaacttaaaaattaaaaaaaaaaacaacacaccagtctagagggaaaaatattgaagaggagagagttagggagttgcacaaggaaagaactctgaagtctgcaaatatgcatgcactgaagagcacttgtgtgtaaagaaactccctctgaaagagaaagacccttgagggaacactccaaagagtgtgcatgcgtgcgcacacacacacacacacacacacactccagtcacagaggaaaggcctgagttacagagcatgaggtggactcatcagaagagcttcggctcagtattggggaaaatgtcggacagacatagggctactccactgtcaactaagaaagtgtagaagcaaactgggaaaagttaagacagtttccaagtaactttactgaatccaaaaataaaagaccaaaatagagaagaaaatgcaaaaggattataaactcaacaaagaaaaattcacaatgattggcattctgtcaatatttcttgcaagcaaaaaagaaaatatatgctttaacacagagaaaaatgaatcaatccaaagtggccaaaaattgcacacatgatagaccttgtaggcacgaattttggagcaattctttttttttttttttttttttttgatggagtctcactctgttgccaggctggagtacagtggcgcgatctcagctcactgcaacctccgccacccgagttcaagcgattctcctgcctcagcctcctgagtggctggaactacaggcatgtgccaccacacccagctattttttttttttaatttttagtagagacggggtttcaccgtattggccaggatggtctcgatctcttgacctcatgatccacccgccttggcctctcaaagtggtgagattacgggcgtgagccaccgcgccagccttggagcaattcttataactcttttctccttcctcatgagaatggaggatctattgaatgtgttaagtggagaaatggaaagcataaagcaagatgcaagttaaacttttagaaatggcccctaaatatctgcattgaaaaaatacactggatgagactcattgcagattagaagctgtgaaggaatagatgagtgaacttgaagatatggcaatggaagttatgcaagatgaagcacaaaaaaagtgaagagagcatcagtgagtttcaggacatcttcaagctgacttactggttataattaaagacatgaagggagataacattggtggggggagaggaaaggtagaaaagccatttaaaggaatcatggccacaatttcccaaatttggtgaaagctagaaacccactactccaaaaagcttaacaagtcacatacacacacacacacacaaacacacacacacaaataacacaccaccaacactcaccataatgaaattgctaaaaacctattataaagacatacttttaaaagtagccataaagacatggtatgtacagatgaacaacatcataaaaagaacagatttctttttctttttaaaattttcttaaacatctgtgggtacagagtaggtgtatatgtttgtgggatacatgagatattttgatacaggcattgccatgtgaaatagtcacatcatggagagttgggtttccatcccctcaagcatttatcctttgtgttacaaactactcaattacactatttcaggtattttaaattgtacaattaagttgctgacatgttatcaaatagtattgatgtaactctgacatgctatcaaatagtaggtcttattcattctttctattttatttacccattaagcatcccctaataagagcagatttcttcttagaagtcatgcaagcaggaggcagtggagctatatttataaaatattaaaagaaaaaacttactaccaaaacccatccacagactcaatgcaatccctatcaaaatacaaacgacattcacagtagtagaaaaaaactctatagttggtatggaaccacaaaatcccctgaatagccaaagcaataccaagcaaaaagcccaggctgaatatgtcacattatctgaatcaaaatatactacaaactacagtaaccaaaacaagatcgatggtattggcttaaaatcagacactgagactaatataatggaatagaataccccaaaataaattcatatatttacagccaactgatttgcagcaaaaatgccaaaaacatacgttgagaaaatgacatacttttcaataaatggcgctgagaaaaactggatattcataggcagaaccttgaaactagacttttatctctctccctatacaataatcaactcaaaatttattaaaactccgaaatataagacccaaaactataaaactactagaagggaacgtagagaacacaggggaagttcttcaggacgttggtctagacaaaaattccatagctaagacttcaaaagcacagggaacaacacgaactagacatatgggacttcattaaactgaaaatcttctgaaaagcaaaggaaacgatcaacagagtgaagacaacttctagaatgagagaaaatatttgcaaactattcaactcaaaagggcctaagatccagcataagaaaataagacaaggagctgaaataactcatcagcataaaaaacaaataatacaattaaaaagtggataaatgatatgaatagacttttcacagtcaaagacatacaaatggccaacaggtatatgacaaaatgctcaatatcactaatcatcaggggtacgcaaatccaaacctccatgagatatcatctcatcccagttggatggctatcatcaagaagacaaaaaaataacaaacactggtgaggatgtagagaaaatagaagacaaaaccacatggtcatctcaacagtcacatcaaatgttttcatgcgaggaaacattaccatttgttgtttttctagtcttgctagagcatcataaaaagataagatttgtggtgccactattggagaaaatgttattacatgcaaagactctggctatcccacaccaaactacatgaacacttactgttaaatgctaaaagaggccaggcacggtagctcacactcgtaatcccagcactttgggagaccgaggcaggcggatcacaaggtcaagagatccagaccatcctggtgaaaccccatctctacaaaaatacaaaaattacttgtatttttgcacggtggcacacacctgtagtcccagctactcgggaggctgaggcaggagaattgcttgaacccgggaggtggaggttgcagtgagccaagatcacgccactgtactccagcctggcgacagagtgagactcaggcaaaaaaaaaaaaaaaaacctaaaagattacaattctgcatttccaaatgttctggtggtcagagaccacttccttgacaagtggtgagtacggggatctgatgggataggtggcatttaggcaggtattgggtgaagaatagtgatatacacaagaaactttcaaagagaaaaacacacggaagttggaacacagaagagaacataatatgtctgagaaataaggaaagtccagactcactggagctgagtgagaacaagaaaaatggcataagccatgtatttctctctggatatctcatcaaaatattgtctcctccccaacacaccacccatgtgaattataaaaatgcccgtttttaatttttgtttgcatgtcgtgacagagtcaagcacgtgaatcaagctgagtttgatgagtccagggctgttaagctccagacccaggtggcctcagaaggacttggtggaacaagggcttgttgtcaaaagcagaggaagtgagattttccattgtggcttagaccagagattcttaaattccagtggacacacaaggccccttaaggatctggttaagatgcagatgcagcctcagcagttctggatgtggccccaaattctctgtgtccggcaactcccaggtgaggctgctgctgctggtcctcccaggaccacactttgagtggctgaactcttattcacccacctcactcaagccacgggtgagactcacacaaggagggcaccttctagaagcacaggtcacttctcactcctccccttgtgtcttagatcctttcctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggcgagccagtgtgtgctgaggtcaatgaggggaaggaagcaagagagaaagggaagataccagtctcatttaaataagcagctcttctggaaacagaggaaattcactcaccccaagtgagggcattaatctattcatgagagatccactcctatcaccctaaaagctcccattaattcccacccccaacactggggattcaatttcagcataagatttgcaagggatgaagatcaaagccatagcaccctgaggcttggccacacacttgctcatctccacatttgtcccttccttcaggaccgggatcctgactgctctgactcagtctccgtctacctcatggacacctggcagtcggtcatcatcggttttgctgaatcagcagcaacattgggggtaacaattgtgtctcctggttccaccagagacagagtagagacccacacagctgaagtgtggggtcaaatattaaaactaagagacataagattgattctcaggctccaagtctgacaagtgagcttctttgagactccctgggatcccagcagtgacactgatcactgttgctgttccacacatcccaagtgatgaggaagtaagaccaaaaccctcctgagattcctgacttgtgtcctgacaccaggtctgttcttccctcccctagaataaaacatctcttaagcacaaggctgaagaaatgtggcctcctcctttctcccacagctggtcaaagtggatacctgagagaattggctcactgaggcctcttgggaacaaaggctgggttcctgcctgtgatctgtgtactgagacacattccggacctgcccaggaaaggcaagtatagatgatgtttagttgtcacagagtccaagtagggacaattcagcggtgtcttcttgggacccctgcctctggctattttcatctactttataatgggccagggccattatttccaacttgtcatatcctttttctcctttcctcaccaggtaaggaggtggaggacagttgatgagggctggcttatgagttaccccaggatgcaaatgactttgaagtcaagcccatgtggggtcaagctcagtctataaccagggtcttttgagctctggaggagccaggcatcccagccatcaaagaggtcttgcatttgctaataaatcctcttcttccaacccacagcttatcttggctgcctaccctcatctctgtcaggaagcaatccttcgttgtttaacaccaaattattcttacttggtcagtttaaaagtcccttcctcagaaaggtcatctgtggcctgaagacaaagtgagaaggctttgctgcattttcatttggaaccttacattgccccttctgcaatgttctaaccacacatggcacatatttacaggacagcgtgataattcacttttgaaaatacagaatgtgctcatggaacaggacaatgtcatacttttggggcctgatgagcatgtccttttcacaggaccccccagagctgcccatgcatccagaaggtaccattctactctatgcaaaacgatggggcatttctatattgcagtttcttagggttccttagaaagaggccacccccaacacagagctgcacaccttgtgaccacttactgtcaattcctcaatgctgtctccaagtctcaccatgcacaagggaggaacacagagaccctggattcctagagacttgcatttcttggatgaacaaatctggggtttggttggtggcagagagctcagggctcatgtgtgagcatcacctgatgcttcctccagggtcagagtccagcccctaccctggaaggatgaaagatattgtccacagaagtggtataaaggtaacagcatcgaggacggagctgcctcttgaaatgggctattgctttgcacaacgctggagacctaaattatgttgactataatggaagagtagtccctgcggatggcctctaattgggtggaagaaagcagagggtctgcgtctgagagagcagcaatgggcagattcagcacaggcatgggcagagcagcaatcaagggtacctgagcagcaatggccccgggagaggcctggcacctgccggaagtgacgttggagacagagaaacatctaagacttaaggcttctctttctgtgcaatcccccaccccacagtttatgtgtcacagatattggcacctccttactgtaaggggtcatatgaataatacagtcctcaggggcatgggttcgaggggcagccaggtttatcctcgaagcccacttctgttacctgcagctgtgtggctgtaagcaaggcatttaatctctcagaaaaccatcctaatgagaggttaagaacctctgagaaaaaaacttagacaagaattgacagtaattcttcactattgaggctgcagggatgtaacttaatcatgtttgtaaagtgcataacacagaccctgacatgccccagctgctcctgagttggcagcaattattcctgacatcactcatgagaattggacctggaatggggatggagggaaggcagtgcagagggtttcagagggttaggaaaagagagactttaatgatttaaaatgaaggcctaggagtggagacaagcgtcctgggacattctcctgccaactctcacaatgtctcagagactgttccaaggtgaagtctactagagagctaagggaggagtttgcagaatcaaggtttgcaatgtcatgcatgagggggcagagagtcagcgggagggaagacagctgagctcatctgaagggtatttatggttttctggccctagagtccttggccatccctctatgaccagggcctcagataagcagagagcttatctgcttctctcctccaacgatagttcctggttatcctgagcccaggtcagtgcagctgtggcccattctctcctctttgtgctcagtggactgacctggaggaaacagtaggaggttcccctgctctctgtccccagggtcctttcctttcagtggcaccagcccagccctagtgtccatccatctgtgcctgcccagtcaggcctccatgctgccccctgtaatggccacaggtcaaaaactgattgtcagtcttgagcagattgtcctgactctttctgcaaaactgagcctctcacccagcaccaggacgtcacaagcaaggccagctgtaggaaggcaagtaggggagtaacgtgcatcacagagtctggacaagacaaagtagttctgctgggacacatcctggtgatgtttctcaggatggttcaggtccctgcaattgcaggcccagagaacaggactgaaggctggaagatgtgctccctttctcctgtacacaaaacagtgccatgtgtgcatgtgagtaaatgcatatgcctgtgtgcttgtgtgtgtgcacctgtgtaaatgcatatgcctgtatgtgagagagtgtgtgtgtaaatgcatatgatgtgtgtgagtgtgtgcatgtgtgtaaatgcatatgcctgtgtgtgtgcatgtgtgtaaatgcatatgctgtgtatgagtgtgtgtgcatgtgtgtaaacgcatatgcctgtgtgtgtgcatgtgcatgtgtgtaaatgcatacactgtgtgtgagtgtgtgtgcatgtgtgtaaatgcatatgcctgtgtgctggtgtgtgtgcatgtgtgtaaatccatatgcctgtgtgtgagtgtgtgtgcctgtgtgtaaatgcatatactgtgtgttggtgtgtgcatgtgtgtaaatgcatatgcctgtgtgtgtgtgtatgcatgcgtgtaaatgcatatgactgcgtgtgagtgtgtgtgcatgtgtgcaaatacatatgcctgtgtgctggtgagtatgcatgtgtgtaaatgcatatgcctgtgtgtgcatgtgtgtaaatgcatataccttgtgtgtgtgcacatgtgtaaatgcatatgcctgtgtgtgagagagtgtgtgtaaatgtgtgtgctgtgtgagtgtgtgcatgtgtgtaaatgcatatgcctgtgtgctggtgtgtgcacatgtgtgtaaatgcatatgctgtgtgctggtgtgtgtccatgtgtgtaaatgcatatgcctgtgtgtgagtgtgtgcatgtatgtaaatgcatatgctgtgtgtgtgtgtgcatgtgtgtaatgtatatgcctgtgtgtgtgcatgtgtttaaatgcatatgctatgtgtgtgtgcatgtgtgtgtgagtgtgtgtgcacgtgcatgtgtgtgtgcatgtgtgtaaatgcatatgctgtgtgactgtgtgtgcatgtgtgtaatgcatatacctgtgtgtgagtgcatgtgcatgtgtgcacatgtgcatgttagtgttgccagggagtgcttcaagtatcgaatgtcccaaattcacaacttttctattttcctcacttacctcctccctgacacatgcttctcagttaagtgagttcatatgcgcaaggcctacaaacaggcaaggcatgggccatagtcagtgctgagtcagtgtcatcaaatattgttatgcttatatagaaccttgtccagggtgggccaaatgtatgcccctgtcttgtcctgacagagcagcagaaagggagactgagacaaaacaatggccagggccctggcaacacggagacaccttcccactcctgtgagcttcacagacaaccctgggtatgggattcctgtcattcctttaagattgttcaaataaacagtgacaatcactctcatatgatatatgagaagaagaagaattccatataaaccaaacccatgacgcccacactgaagcctgccaagttctctccagtcgagcccaatggagggagcattttcatggggacttttgagagtatggagaagacctgaggaaaccaggctcagctgtgggctccagaggcaaagctctgggatgtctccccatggcctagacccttcgcctgccacctcttctcactctttgcacagatgcttcccccaggctaagcccccacaggaccctaatcctagtcctgaccctgagctcagcccaggtgatgcttcaggagatgggaccctgagaataagccctaaagtctcctcaacctgcaggctctgtagtctcttaaagactcaggtacctccagtagagttggccatgagacatctgtccctccaactgctcaggagcaggcaacagtgcagagagaaacagcagcccaggccaggccctacactcaaagcagcccccaatccccacagatcctccagcgctaacctggggtacaggccccacctctgcaggctgaggtgggctcctcagcatggctaggccatgacgggggatggcagtgtgtccatgggacacagccctgctgcctgcctggccctcatgccccgtccctccccaccctggttaagctctgccccaaagggcccaggttcataactcaggacacctggatcggctcttggacttgcccccactgttctctgttctcctgagccacttagtttcttttggccacagtgttacctgctgcgaagtgaggaggcttatactgaactgaagaagcacttttcttcattcaaaattaaaagatagaaaaacaatggaagtcatgcgaatggggggatgtcatttaatgggcttcagtgggcttcagacatggaatttcttgtctttcctctgcagagattccaagaaaaggactcgaaaagagcttgctttctatatggtgggaacagcagctgccagctaagaataagcaggagagtcccagtttcatcaggaaaacagactaggctagtatggaaatcctccctgcagaaactctgagaagtgtggaatgaaataaacataaacatgaaattaatctgccaacgatggtgatgttagctcacaactaagctgcagtgccagaaacatgcggtgattgcagtgaatcatagctgctcttactgggtgggaggtgcaccagtttgcttcctaagtgcatagaaagcctggcacgcacgtctctctggactttgaaagcttggcagaagagcttcagttgacttactctaattagtcctgacggaacaaaaccactagagtagggcatttcaaccctgagacacttctgtagcaattgctcctgccccacatccctgcactgcatgtgtgacctctctgtggtgggctgggcagggcagattgggccacactggcacagaatggggctggactctctggtcctcaacttctgaggtgacaggtgctgtggggtcacctggaaggaaaaagctcctgggctgagtctcctccaccagttgggggcagcagagctgcagccagcagcagtgaggagagaggctggggctgcccagccggggaaaagaggaaggcctgcctaaggttcaacaggtgtccaagaatcagtcttcagactgaaagtgaagacagttcatcctatcccctcaggctgcagtgaccacgctctgagggtcagactcatatagtgttactccaggacactgacagaagcctggcacagtgaaggcctcacctgggaaatgctgctggaggaggctgggcccaggtgtcagcttgggcagcttcctcaggaaggggattccctggaagaagtcccgaggtcaaggtgctctaggaggggcacagtgtgaggtgacggggttcccagggcctgggttcttcacccaggatggcggcctgagcctcctgccactctcagggccttgtcctgccctgtccagcagtgtcctggggagctgagccctctgtcgtgggcacttccagatacaccctgcctaccctccctctgcctttccttccagctccaggcagactctgactcaagggcagctcctgtgcttaggggagtctcaggtgggtggcgtgaagtatttggggccctggtccctgcatggggcatcaccagcctcattgaggagacactctccagagggatggggattctcacctgcctcaggccacagccctgaccccggacctgtccatgctcagtgacaggacaataaccaggaacctggctggagtaaccagggaccacccatcctctggagctcacatgctgtgcagagaccatgaccctgggaccctgggaccctgggaccctgggaccctggaaccgtgacagaatccatggggcctaaagttagattctcagtccactatggttttctgctgctttttgcaagtttacataaaacattgatgagaaaaacataaataaataacagacgagctgagggtgccaattgcttatctcttgtggcaatgagggaatggtatagaaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctggtccacctgctgctgagtcaggtgtcagcatgatctctcggcagggcccagctcagccccatggccaaactcctggaaggtccacagctctgctgagcctggcccaggacagaccccaggtcaacgaggtttgggacagtggtcatgaagtcaattcccaagaaggtgactgcgatcacagggcttcaaggctgcagctgattttctaaccagagatcctgcttcttcttcttcctcttgtcgcctgtgctgcccccacagctggtttgggtgacatctctccaagaggagtcccagaggaagtaaatttgcataaacaccaaacactgactaccctaaaaagcctgagagagaataagagaggcctggggagcctagctgtgctgtgggtccaggaggcagaactctgggtgtctcaccatggcctggatccctctacttctccccctcttcactctctgcacaggtgctgtccccaggccctgctccaggccctgctccagtcttattccccacagatcccaagttgagcctgccctgaatcccgagcaaagcccagacgcagcctctgggtgcgactcctgggaatgggtcctttgtcttcaagccccctctcttgttcttccttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcccacagtgacacaagcagacagggaagtgagacataaacccctccccctctatttcatcctcttcctcctgccccaggaggactgtggacaaagccatgagtaggcttggccaaattcacccaaatctgaacccccaggctgcccttccctccagccctccaggcaggcactgcagagtagtcagtctggagtggatttgtgcctggcaggccaggctgtcctgtgtttctttgcctggggtttgagttgtcgatggagggtctgactggaaagacagacacagggagacatccatgcaggcatgtccaaagggacatggggaactctcaggtctcagttgaatgcagtcattgttgtatcctctgggaaagcattcctctagtgcatctaagacctccagacccacagagcctgagatcaggaggagagaatgttaaatttttgctaatggaccactgaagacatttttgagtggagccactacaatttactccttgattctggactcatggatcctgactgtgggagaaacagcaccatctattgggcactgatgcacagaacatgccctatcctggaagacattgtccagccctacacatacttgccacttgcctggtgcagtaatggtgtctccaagcagtcattaaaccattcatataagccatatgtctcagaatgtttgggacaagagtaagaatcttgattgccagaagaaaaggcccatagccctttatttgcagtgaaatgaattccttggtcagaacctcctgtggaataccatcatgatgggtgcgtcattctgtaatccagagacaacagttttggcagaagcattgctgtcaatgaaagcaaatcctctgtagaataaatgtcaattctagtaagaaaaaagagctattcctgccatgatggaagagtgcaaacgaaattaatattaagcaggcccctggctgttttccacagagaaagtcatcctatagggatctctgtgttagtctctgctgttggcagatggtcactcagcagtggctacagccaggccagctccagttagtggaaatcgacattgatgagcccatggacagcctccatccctgccaccatgggcgcttttttttatggagcccactgggcattgacaagagtggttgagggaggctgcctgatgtccacagaacaagtcaccctactcacctgattagcaaaatcacttcattttcacagaagacttggtgagtattgacatatggaaaaaattctcttactttctgcccaccggaggaggtctattcacacatctctccccctgacgtatttgtgatcaatattctcattgtgtctctctcaagtccctgaacatccttgagcatctttcaagaccctgagtcacaacctgtgaattaggaacctctgcccatctcttggcaggtgacatgagccaattgcactgcttaaaattctactttaatgagaatgttcctccaacactgctgttcagggattctcagaggccaggtggagtactagcactgtccacaccagtagtggctgcatgtcctgcagaaaactctgtaaccccagcctaagtgcctcctcctaggcagctgatctcagggagcccctcaggacgtcaaggctgtagggtgagaggaagacatggtgcagggctccggtcatgtctatttggccaactcttcatgaaacttacttgggcctcgtgacctagtccctcaagtcacaaatacatccctgccatgtgattgaggagctgctggaaatggccaaccgggactgtggttcagaccaaacctagcatactggcaacttgggtcgcatggtgagctgtgtggccacaatcacacagagcctctgctgaggcccaggagcgttcgcagtctttctcaaatggagctttctgctcattcaaaaaaataagtagagggaggctgggaccccaggaccacttagaccacgcacatgatcttgtctgattattctgaatccttgcatgctcagctatgcattatggtaaccaagccacagtgtctttggcaataaaatgccactacttggcccccacctaacctgggatcccctcaaccacatcttgctacccaaaacaggtttcacctccactgagagaaatttatttttatattgagaagatgaaagattaattatttcaattgtgaaaattttataggacagtaatgtgaaaatattttaaaagacactttacgaagagtgaaagaccttccattaaaccactcaatatatgacactgtaattggcctacccaaaccctaagttcagctccgggttgggaccttctgggaatggacccttcatcctcacgccctcctctcctctcctctcctctcctctcctctcctctcctctcctctcctctcctctcctctcctctcctctcctctcctctcctcttctgtcagccctgtgcctcctatgtgcagagacagctggtctcagtgttggtggccctgggactgacaatcatgagcacatactctggagataaccttgagataaacatgcattaaggaaccagcagaatccaggccagtccatggtgctggtcatctagtataacagcaactgaccctcagggacatctgcccaattcttaggcttcaactcagggaacatggccaccatgaccattaatggagcccaagcccgggaagagactgactattgctgaactgcagataataacagtgggagcagctggcagggactcatagtaacacagagagacagggactagccacagaactgtcccatctcggcctggctctcattctcagctgccctgtgagcagctgaaggtcaggcctcagggtcaggcgtcctctctggtcttaacctggcccctgcagggctggtgattctgagcagcttctccatcctctcagggcctgcatgtgtccagtgagaagtgagtggacagggggaagctggttggagctgcaggaacctctgtcaggtttgtggtgtacatgaaaggtttaggaatccacacaacatcacatggccccagatgtaatcacacatcacacaggggaggaaagagctgtcgcagagggtacagtcctgtggaatttctcttttccttgggtataagcagcttagtggaagctccagaggctgtgtctcctctggtttccagatgagttcagttgacctccgcattctaaaggggtgcctgaggcctgaggaggactggagacccagccccttttggccccagggccctttctgtgctgacatttcacagaaactgaagaggaagaacagacactacctttcatcccacctggggactgtctttggggcacgctgaactcccatggcccccaaagtcccatcaccttccccaggtaggtcagacctgactggatgtccctctagtgccctgatagtgtggattttatctttgggctctgggctgctttctgaggagctcactaagaacccttgatgccaagtccaggacctgcccctctgctccatgtcccaggggctgcaagcatgacgggaaggtcctgctgggtgaggatggtgcccttttccagaagagatgtctgattccagtctctagggccaggtttgttgggctttttttctcacttggaaggtctcagtctctttattaccttctttaaaagtacaattggtttaatcgtgaaatcatgtgcatgcactaaagtttacagactatggtcatcagcacatatgtacactctttctggatgggacaactgtggacacggccatactggggtctctgtctctctcattatcacaagggaggataccaacagctctctcctatgcagaccgtagtcatgtttcccaattgcacaagaatgtctcttacagttgtttaatttccttcccagccaggacgcttaagtttcccatgctgatacttggttgctatttctctctgatccaacatttttcaaacagtattgcttgcaacccaaggcttatgaaacactttaccaaaagttccacaagaaaagctcaagtttctcatgcaccgttggaccaggttcattgcgtgcagtaggaccttgctcaagtgatgagtccatttgatgttttcaccatcaaggtgaagggtattatgacttttgggcactgagttgatagaaggaagacagcagctgatgatggccctgcccaccgatgtgtgtgtgtgggcaggacctatcgatggatttagaagttgagggaactgtttattctgcagatggaatttccagcactgaatctccaccaaccagacactagcactcagcaggtgctctgtaagaagaagcccttcactgccaatcacggccattacacaggtgaaggagaggatgatttttaacagccattgaccctcacagtaaactgaggtcaaaactctggtacacaaagtgactttgagagaacaggctgaggaagcaggttaattagtagcagaaggctttgccgagagcaggaacaaaacagggttggtgaggaactagtgatgccatggtgtggaaggaacaaggcctgtaccaggagcaggaaggggcatgggaaagaccacactgccacatgtgatgagtcagcacatggaaggcacagcaaatgttgcacaaaggtttttgtgtaataacctggcaaacagctgcttctctatcaagattgatgagtcaaaaaatgttactgatgcattgctgtcacatgtgaaggtgtgtgaagaatggtgacattcaaggaaacctgttctctgcagacacctacccaccagtacagcagacaccccagctatgccaagggctttgtcttcctctggggtaagagcctgggaacaacaagttggcccctgaaaggggtgccccatcatgcgctcttcatggctgagttaagtggggagctcccagagaactttccagtaaatggtcaatctgtttgttctgggtgcattgagcatgacccaggatcaatggaagtgacagaagcttaatttccccaaggctgcaaggcgggcactgggaggacggctgaagcagtttagccaccaccccctagtggctccagccccaggtaagcagggacagttgaagggcctgcctgagcccacctgtgtctaattagttccagcatcagcagctgcatcctgtagaccaccaaggagtgtgtgtgcccagcccctcacagatcacctgagcataaacaggaaattctccttcttacacctgactgcaccacacatctgccccttgctcttcatttacaagacgctatcacatcagacacggactgatctgagtcccgggttccctcaggtttctgctgtcctctcagatccccacacacaaaagactcttcaccacagggcgttgagccagctcttcccctaacactgcctcttacaggttactcttctccaatatgatgcgggtttgatttcagtgtttctacatatatacttttgtattttattgggtaagctgagccccttgtacctgatcttgagtcaggcaggggccacacagagaagaggtgttcctcccctgggaccagcagtcctcggatcagggcatcagggacctgaacagcaggttctgaatccacacctagacccaggaagtccctgagcccccagcccacagtgtggagcggccaccagggggaagcagagagttacctggcaaagccacctggcgatggggcgggcctgggtgacagggagacgctgacatgcagcaggagccagtgaccatgatctcacacctggaatgaaagggtctttattttcatagagtattgtccttgtgtacttgacactcatgtagaaattctagaataggattttaccttcagctcttgcagatgctgcctctttctctgccacagctccaggcacttgacttctcacagtgccctctcctcacacacccagttgtgctaaaatggtgtccctgccatgtgcagtgtcctccctgaggtcacaggtgtcccctttatctcccctttgctctgggagcccctgtcctgcagacacagtggcttctcctttcctggctgctcctccactttcattgtccctggtctttccggactctctcctggggaagctgccaaatcatggctcttgatttcctggtgagtcacaaaatagttgctcattaacctttagttgacttaagttcttaatcattgatacattttccccaacaactgacgacaacttagttataataaacattcacttctgggggtcttggagtttgcagccccctctcattctctcatggagcaaacatttccttcgcctcctcatctgtctctgatcctgacagcatcctggagatactgaggcacagcagctatgacctacccaggagcttgcagccaaggcagaaacttccatcacctcatggatcttccagcactctgtgtgcacttgacaaataagaaattccattgtcctctaccactcaggagctgtgccctgcggtgggacctgcacctttccaaggtgtgtgttatcatctgcacagtggagatgaagagggaacctgcattgggttctggaaagtaccatctaaaaatatatttagacctgcaacagaaatctcctctctaacataaaatatttatgatcaggacacactgagaggcctagaccaaaattaagcactgccctcctgagccaggatagaatggaggaggggactggggaccccagataattccacagttaccagcatgactctatgatcacctcctggaccagatcaaagatcatcccatatgaaggacttcatattccttaggaaatacaaagtcacctctgagctctgctgtgaccaagtgagcccaggaatgaggctgagcacagtgtgatgtggagatgtctgcagagaatatggaatcaattgataaaggagatcctgtgggcaaagggtgggagggcaaggccacccctaacctctttgggtcccttggggctgagtccttctggaaaccacaaagctcctccagcagcagcccctgactctgctgattggcatcacgggctgttctctccaacaaggggttaagagagacctgggaggagcctgcccagcctcagacttgagaagcagcattggaggcacttcagccatggcctggcccctcttttccttggtctcctgactcactgcccaggtgctgcccccagggtctcacccacctgcccagccccaggcctccaggttcagcctggccatcagtctgagctcagcagggccctgtgtgtggtgggcaggatgctcgtgaccctgctgcagggggaggggctggttgggctgaaatgcccccactctgtgctcctgtgctcatgggtgccctgagagctcttttattcctggggctcactccagccctggcaagtagcaagatatcctggggttgagcctctcagtttcaaattttttatctcccctttccttcttgcaggctctgtcacctcctgtgagctgacacagccaccctcagtgtcagtagctccaggacagatgactaggatcacctgtggggaaaacagtattggaagtaaaagtgcttaatggtaccagcagaagccaggacaggcccctgtgtgggtcatctatggggatagcaggcggccttcagggatctctgagattctctggctcaaactcagggaacaggaccaccctggccatcaacagggcccaggctggggaccaggctattactgtaagatgtgggacattaggactcctcatcccacagtgacagaggtagatggggaagtgagacacaaaccccttccccatacgtgtcactcttgtcctccagcccaggaagactgtggacaaagccatgagcatgggtttcccaattcacctggatctgagaccccccaggctgccctttccacaggccctccaggcaggctctgcagaggggacatcaagactgaatttagggcagaggtgaccaggatatattgaggtttgggggactcagttgtgatttggggaaatggggccagaatggaaggtcaggccaaggtcaacatccttagttggtctctggatttccatagggggtgaaggccagtccttgggctgaatatcctgagtcagtttccagaactgcccagctcaggctcccatggcatcctgccattctctgaaaagggccctggcatgccaggtgctctgggttctgagggagagttggaatcagatcctcctgcaggaatccagggtcaggagaagcagcctcacctgacacagggaccacagatgcacccccacagggtgagctgcaggatggatgctgctcatctccaatcctcacatcctatgcaaaaaatcattcttttcacccctccttcagtgtatcaaagttgacacttaaaaagccttaagagcccactcttgtcaacagaaaacccattcacatctccatcagccacacaatctccacagaatgattcttcaaaaaacgataacagtagacatgaaaaggtatctaaaatgttacataaataattgaacttagattacatatgaaaatgatactatttttggtatgctaggtaaataaaatatattatttggactcctttactttcttctctttgtatttctaatgtggtgactagacattgggattccaatgaggctcacatcatattgtgattgaacagtgctggtctgcacctcttcaggtaacaggggctgtggagtgacctggtgcaggaagccccatctccaatcataggacatcagtgtgaacccagggagaggcactggtgcaagagaaatgagaacaggagtgtggaccatctgcttgtacaggggactgagccctcactttgagccaaataaactttttttctattttcaattctgaagaagaagactttcctggacttctttccgttttcagatttgtgccccttcaggtttggcctgtctggatcccagccaggggacaccgaggaaatccaggagtctcacactgactctgttgtatttcatctgctggggtcatcccaaactgctgcgtatcgtttcctttcctggtgctcaaatagctgctccatgcacttgtcacggtttcatagctcagtctaggtgggaagacaggatagtgtatgttataatatttaaatggaacctgaatccattcattgtttttgtttttttgtgtttttgtttgtttttgttttgtttcgtttttgagagagagagagagtcttgctctgtcgcccaggctggagtgcaatggtatgatctcggctcactgcaacctctacctcccaggttcaagcgattctcctgcctcagcctcctgggcagctgggattacaggcccccgccaccacatccagctagtttttgtattttagtagagatgaagtttcaccattttggtcaggctggtctcaaactcttgacctcaggtgacccacctgtcttagcctcctaaagtgctgggattataaaggtgagccaccacgcccgacccaatagtttttttaaaatatgaaatgttaaaagagttttgtcataggcattgggaaaggtgaaaatagattaaaaacattttaagaaaaaaaccaaaaatgtacttgtagactgtctgtgtgtcttcagtgttgcagggttcagagaggtcagttttatggttcactaaggaggggctaagatggaggaaaccaagaaagccaaaaacacacatctctgccactcaaaacataaatcaaagtaaaatggaaaaaatctttcaataaatcattcccaataaatatcactctggtgcacatagaaaggcctgttagcaaactttccctttcccctgctggctcatatccccatggatcacctgtgtgcagagtggactctgtggtccccatttctcaggctgagaaccagagactgggaaggacaagtcacctgctcatgagtgggaagggcaggattgggagcagctggcttgggttcaggactgtggccctggtcggtgctctgtgtccctccagagggtccctcccacatgtgccccgtgtggatgtgggtgcactgcctggggtggctgatgtgctccagggattcgatggtgcagatgcttcagcacaaaacgtggaggtggggatgggatgaggctgcagctggggagaccagagaccagcgccacccagcagaggtttccacggggtgggcagccccatttcctgacagtagagacaggctggaggtgggtgccaagcagagggcgctgtggggtatgcccaggcctagagagtcacagagacacaggcactacacagcagaggcactgagggccaggagctcactcaggtgagagacttcagcagatccttctctcctgagcaaatcaggtacaaaaaaaattaagttcctgccatcagcatgcacaaacaagaacattcatctcttcagctgagccctgctgtccagggaagcaaaagtctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacaggtgacgcctccagggaaggggtcttggggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttccacagtggtccaagttcatggggaactgagaccaaaacctgcccagggccttcagacttcctccttgctctgaagatgcttcctcacccggtgcaagaggcttgctgcagcgcggccttgagaattcttctctctcagctccttccctttccaccatgaattccaacaggaaacctgccctgtggtttcccatccaggacagggacagcttcctgatgcttgtgtgctgtggtccctgaatgtgcaactcttcccagctcttcaaatgcagggacagtgacaaggagctgcctgattggtgcagtcactgcttttttcagggatgtcttcaccctacatgtatcatcatcccctacactgtgggtagaattttagcaactacattctaatggttatcgccacaactttgatcttagaaataacagtgcagtgaacatccctatgcaggctcctttgagttcctgtgtgaatacgaccataggattcatttctaaaagtgaaattgcgggtcagaaagatgtgtgtttgtgattttcacccaatgttgtcagattcccctccagagggattgtaccaattttcaatgccagctggaagtacttgttcagagtacattgttgaatgtggaaatttttgccaacgtatcagagtgaaaaatggtaccttgttacagttttatttttcagtctcccgttctgcttaaggttgggccttttcacaaatagttcagtactcttcatttttcatgatttggtaaactttataaaaaatatccagataagaagaattttagtctttgtggccagacacggtggctcatgcctgtaatcccagcattttggaagactaagacgggtgaatcgcttgatcccaggagtttgggattagcctgggccacacagtgaaccctcatctcaattaaattaaagaaaataaaaataatttttaaaaaaatcctttgtggtccaaggatcaactttggggatattacctatggacttatatcaccatttacaatgcaaacatttaaaatgataacaactactgtcagctgcagaactaatttgactccatcaaaaaaaaaaaagctaaaagattataattctgcatttccacatgttctggtggtcagagaccacttccttgacaagcagtgagtacggggatctgaagggtagttagcatttaggcaggtattgggtgaagaatagggatatacacaagaaactttcaaagagaaaaacacatggaagttggaacacagaagagaacataatatgtctgagaaataaggaaagtccagactcactggagctgagtgagaacaagaaaaatggcataagccatgtatttctctctggatatctcattaaaatattgtctcctccccaacacaccacccatgtgaattataaaaatgcccgttttaaatttttgtttgcatgtcgtgacagagtcaagcacgtgaatcaagctgagtttgatgagtccagggctgttaagccccagacccaggtggcctcagaaggacttggtggaacgagggcttgttgtcaaaagcagaggaagtgagattttccattgtggctgagaccagtttcttaaattccagtggacacacaaggccccttaaggatcggttaagatgcagatgcagcctcagcagttctggatgtggccccaaattctctgtgtctggcaactcccaggtgaggctgctgctgctggtcctcccaggaccacactttgagtggctgaactcttattcacccacctcactcaagccacgggtgagactcacacaaggagagcatattctagaagcacaggtcacttctcactcctccccttgtgtcttagatccttttctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggggagccagtgtgtgcagatgtcaatgggggagaggaagcaagagagaagacaaagatgccaggctctttttaataaccagctctttcggaaacaggggaattcactcaccccaagtgagggcattaatctattcatgagagatccactcccatcaccctaaaagctcccattagttcccacctccaatactggggatccaatttcaacataagatttggaggtgacaaagatcaaagccatagcaccctgaggtttggccacacacttgctcatctccacatttgtccctcccctcaggactagggtcctgactgctctgacttagtctccctccaccttatgggcacctggcagtcggtcatcatcagctttgctgaatcagcagcaacattgagggtaaaaattgtgtctcctggttccaccagaaataaagtagagccccacacagctgaggtgtggggtcaaaaattaaaactaagagacataagactcattctcaggctccaagtctggccagtgagcttctttgagactccctgggatcccagcagtgacactgatcactattgctgtcccacacatcccaagtgatgaggaagtaagaccaaaaccctcctgagattcctggcttgtgtcctgacactggggctgttgggattcctgtctttccttcaagattgttcaaataagcaccgacaatcacttccatgtgagatatgaggagagaataattccacatgaaccaaatccacgaagcctacactgaagcctgccaagttctctgcagtccagcacgatgaagggagcattttcatgggaacttttgggaatatgaggggagccaggctcagctatgggttccagagacaaagctcctggatgtttccccctggccttggtccatcacctgctacctctcctcactctttccacagatgctgccccaggttaagcccccacaggactctaagcctattcctgaccctgagctcagcccaagtgatgcttcaggagatgggatcctgagaatgagcgccaacgtctctttaacctgaggtgtgaggtcatgagacacctgttggccataagacacctgtcccccacctgctcaggagacagtggagcaggcaacagtgcagagagaaccagcaggagccaggccaggccctgcatccaaagcaggccccaatcccacagattctccagctccagcctggggtacagccccaactttctgtaggctgaaatgggcttctcaggatgggcaggccatgatgggggatggcagtgtgtccacaggacacagccctgctgcctgcctggccctcatgcccactccttccccaccctggttaatctccacccaaaagggcccaggctcagaactcaggacacctggatcagctcctggacttgcccccactgctttctgttcccctgagccacttagtctcttttggcctcagtgttacctgctgtgaagtgaggaggcttatactgaactgaggaagctcttttcttcattcaaaattaaaagacagaaacaataaagtcatgtgaattaaagccttctaaggggatgtcatttaatgggctccaatgggcttcagacatggaacttcttgtctttcctctgcagagattccaagaaagggactcaaaagggcttgctttctgtatgatgggaacagtgatctccagctgagtataagcaggagagtcctagtttcatcagcaagacagacaaggctagggtagaaatcctcctggcacaagctctgagaggtgtggaatgaaataaagataaacatgaaattaatgtgcctatgatggtgatgttagctcacaactaagctgcagaaccagaaacctggtgattgcagtgaatcatagctgctcttactgggtgggaggtgcaccagtttgcttcctaagtgcatagaaagcctgggtccctgtaggatggcatgcacatctctctggactttgaaagtgttgcagaagagcttcagttgactcactctaattagacctgactgaacaaaaccattagaggagggcatttcaaccctgagacacttctatagcaattgcacctgccccaccccactgaactgcgtgtgttacctctctgtgctgggctgggcagggcagattgggtcacactggcacagaatggggctggactctctggtcctcaacttctgaggtgacaggtgctgtggggtcacctggaagaagaaagctcctgggctgagtctcctccaccagttgggggcagcagagctgcagccaggagcagtgaggagagaggctggggctgcccagctggggcgaagaggaaggccagcctggggttcaacaggtgtccaagagtcagtcttcagactgaaaatgaagacagttcatcctatcccctcgggctgcagtgaccacgttctgagggtcagattcatacagtgtcacccaaggacaccgacagaagcccggcacagtgaaggcctcacctgggaaatgcaactagaagaggctgggcccaggtgtcagcttgggcagcttccttaggaaggggattccctgggagaagtcctgaggccgaggtgctctaggaggggcacaatgtgaggtgacagggctcccagggcccaggttcttcacccaggatggcggcctgagcctcctgccactctcagggccttgtccctccctgtccagcagtgtcctggggagctgagccctctatcgtgggcacttccagatacacccgacccctcctgcctctgcctttccttccagctccaggtggactctgactcaggacgcagctcctgtgctcaggggagattcaggtgggtggcgtgaagcattttggggccctggtccctgcatgaggcatcaccagcctccttcaggagatgctgtccagaggaacagggcttctcacctgcctcaggccacagctctcaccacggggctgtcctttgatcagtggcaggatctgcatggctggagggactactgaccacatgctctctggagctcatgtcttgtgtggagaccatgacctggggaccctcagaaagaccaagcagcctaaagttagattttcagtccagtgtgattctctggttcttttcgcaagtttacgtaaaacgttgatgagaaaaagtgaataaataaaggaagagttgaggatggcaattgctggtctactgtggggctgggggataccatggaaagagcagcaccacatgtcaaatgagactagagattgggatgcatccgaaatatgtgtggttgctcaaatgacaaaactcttccaactgcaatgattcataagtgtcctacagacacagtacatcatgtacataacattaccaggatggggccaagtgactcgggggtatcaggagcagggatgaaagaggagaaagatgatgcatctttggtgtacttgctgctgagtcaggcgtcatcagtgatttctcaacagggcccagctcagccccaggccaggctcctggaaggtccatagtcctgctcaatgcagcccaggacaggccacatgacacagaggtttgagacagggaccatgttgtcaatccccaggacggtgactgtgatcacaggccttggaggccaaggctgattttctgactggagaagcagacgaaggaagctggggattcaccccttcattttaagtttctcatgctgcccccagagctggcttgagggatatcccgccatgaggagtcccagagaagtaaatttgcataaacaccaaggatgcactgccccagtgggcctgagaggaaataagagaggcctgggaagcccagctgtgctgtgggctcaggaggcagagctgtgggtgtctcaccatggcatgggccacactcctgctcccactcctcaacctctacacaggtgctgcccccagaccctgccccaggctcagccctcctaagcccctggtcttaccctgaaccctgagctcagcccaggcatagcctcagggcgatactactggaatgggtttgttatcttcaagccccctctcttgtcctctcttgcaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctcagtgacacaggcagatggggaagtgagacacaaactcctttttcatctgtgttgtgttcttcctccagcaccaggaagactgtggaccaagcaatgagcaggtctggccaagttctactggatctgagacctccaggccatccttttttccagctgtccaggttggctctgcagagggtggagcaggagtggatttaaggctgctataatcagaatttatggtgttttggggcctcatgagtgacttggggaaataagaactggatggaagatgaaagagatgtagagaaccatcacttgaccttagatttccatacgatggtgattgggtcactccttcttcaaaatatcctacatcagtcccgaaaaatacccacctcagctcaacacctgagcttccaggcttccatggcagcctgggattttgaacaggaaaagccaaggaggggacactgtggcatctgcctcaatacccttttctgagctcacccaacctcaactgctgggagcttctaggagctcagagctgtgccctcactgggaagtgctattagctccaaagaaaacttccttcctcatatttaggcccagttttgagagttttggtttgatgactgcctgagccaagaacccaaggccctgtcctaatagaggatgacactgaaaggccttccagatccagacatcccagtatggatgcctgaggcctcagttgcaaccctattgtgggtcagggtctccttctggtgggcgatgcctccctcactccttccagatcctctgtgcatgcacatctttttctcagagtctacttccaggaaacccaaactaagatggctggctatcaccaaaataaactaccatagacctgaggtggaaacaccagcgaatttcccaaatttccattgtgaacatccaaatgcccatttatatctgagtgttccttgtattcttataaaatgaaaatggagcctgacataccaggtttttggagtcctgaaggagatgtggagacagatccttctgcaaggaatccaccgaaaggggagcagcctcaccccatgcaggggctggagatgctcccacaggggcagctgtagcatggacgctaccaacctccaccctgcacatcctgcacaaacaatcactctttcacccctccttcagcttatcaaagttgacacttacgaagccagcacagctcacccttgtcaatcagactccttcaaacctccatcaaccacacaatctcaacataaagaatctccccaacataataataggaacagtagctatgaaaatggctataaaatatctcataaataattttagattgtgttcatgtgtaaatattatttttcacactttgggttaaataaaatatattactgaaactagtttacctttttattttttatgtctagtatggtgactagacagtaggattcacatgagactcacatcatgtgattgtacaatgctggtcttgtcttaccccttgaggtggcaggtgctttggagtaacctgcttcagcaagccccatctccacccgtaggacatatgtgtgaagccatggagaggcactggtggaagagaaatgagaacacagatgtggaccagctgtttatgcaggtgactgagtcctggagccctgatcctgttctaacctagatgtgtcacatccatctcaccagagaccgctgctggcctgccttagctcataactggggggatctggcagttcatgaaacatggtcgcttgatgtccagtgttatcctgtctctctcagggcccaataagacaaaaggagctgcttttagaaagggaagtaacactctactgcacatgacatggccttattccaaaaccccatgagtctacgttgggattctccagtggggtttgccatgtacaggaggtttcagttcccacagtagagtcagctggattctctggacccaacagcaggacactcacaaccctgcctgcacctgctgcagagcctcaatgctctgggcctggaaaacaatgggtgatatttgtggctcctgatatatgggttggagccacatccccaagtgtaaaatatgctactcctagacctttatagaccttgtgtctgtttcttcctggagggaattgaagggtataataacatgttctttaatttgtaggagactctcagctgctccagacaactgaagtcccaatttctgctaatacagaagagggaacagtttatttcccactcttaaaagtgcatggatctcacaaaagcttccagtaggccatgcccatcatgtatatgtgattcaactatgatatcaagatggtctgaaccctcatgatgatatcatgatagagataagagagctaatgatgctgggcagagaaagtgtgaatgtatactgtcgtccattccacctgaatgcacactgattctgatcctattctctgagggaaatagacaagacctcagtatctgcttcagtgaggtaactgtgcacctgcagccatagcattctgttcccagagatccccatctggcacagatattgctaatgccactattgcccatctgggtctgtacaaatccaaattcatcttccaggatcattcaactattgtagagatcagtccagtaaactgaaaacaaaaccccagaagtaatcacacgtactgcgggagaggagagagctgtctcagagggcacagtcttgttgaaattcctctgctccttgggaagaaacagcccagaaaaggccccaggggctgcgtctcatctgggttcctggatgaggcacaccccctactgcactgagattccacagaagctgggggtgaagtgcaaataccgtctttggttcatccttgggattttctttttatcacacactcgtcattttgtccacaatgtccaaagtttctaaagtgctgtctaatagatagaggttctttgtgcgctgaactaaaagctcttgggttggacaatggtgatgtttgcacaacatttttactgtacttactgccgcttaattacacacttaaaaatgattaaaaggatgaaacattttgttatgtttattttaccataataaaaatattgcatgctcaggaagcaaagtaattttgcaattatacaactgttaaaaatggaagaattatgtactgagcaccattttctctgttgtttatgctacaattcaactttctctctctctcactctttctctaattagcaatgatcttctgtctggtccaaggtcacacatttccagtcttccagaaatgtctgttgaatctgttaatttgttgccaggaagaatactcaaacttctcatgctcatatttgagtgttagctgtctccagccagcatttctaagccagaccctttgtcaaggcttttgaataattttgtgaaaagtacccccaaagatgacagtgttcactgttggcagcaggactgtttccatgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctattggacactgagtcacatagagggacagaaggtggctgaggacaccttatctctgatgagcataaggggattagatctgctggtggaacaggaagctgaagaaacctgtggctctaaacatggaatttccagccctgagtctctgctgtccgtgcccctctcatctgtatgttcctgggagatgtggaccacgggggttagaggtgaaggggattgggaagctttcatgttctctctcaccatctcccttgcttatctaacacactcttacacacctactttattggagcttctgctctacaaacatggctgagctctaaattagagacttttgaaagtgcagacggatgcaggaactcgtccatctggagactttccaccacttgaagcagtgaacacgtctgtgcaaggctcagaatttcaagtgacaggatgttgggatttcaaagaaaactaaatctttggatgaaccacgacagaagagggaaggttcacacatttccctgctgcttgggcctcagtgaggactgactcagccagtctcaggctcctggagaccgcctgggagatctgcactaggaaaccattttcagcacagcctggggctggtaaggggcccttactctgttattctgctgcctgataattttgcatccagagaagaattaggacctgtgagtccaggaatttcaaagcccatagacaaggtcccctcattctgccgtgacagcctcagctctgctttcccaaaaaaagagcatcttcccagcatgaagaaccaggagcaaagagggagcttctcccaggggtgagcagggcagaagccaccttggtcagtgggaaggaaacatgctcagctcacatctgacccagaatgactcagtcacacctgtgcagggtcacctgtgtgtgagcatcatctatttgctccatgagaaaataccttgtgtggctcttgggtaaaatcataccataggtgacatttctctgcctattgcttcagccgatgcttttcgtgattccctttaggacactggcataaggtaagcatgtcaggtgtgggacgtattgaacaggaaaagcagaggcttctcatatcaatgctcgtggcttgtatttgggcccatacctcatggaaatgggaaaaacagaaaagaaaatgatactctgctcaaaaaagcactgagaaatgctatagtattaatatatcgacaactcatttattgagctaatgaaatattaacatagatagatcatttttatagggggatccctaatccttaaacattatattaaaaatttgtcagcttaaaggatcattaaaaggcctatgtttgattgaaacctggagtactgtactttgagtcttctaatcagccaatgagtgcagggagctggctgccctcccaggtcctgactggctccatgtccaggtagagcagcgctccccacaggcagctggaggaactgacgaggggaagctgttggcatcagggcctcaaaaatttgactcaggattttcccacgtcccctccccaagtccaggcgggttccaggacactcagaagagctcatcattatgggtctaggacttccctggtcctgctcttctttcttccttccccagtggccttaagattgtcactccctgtcacaggcccttcctttccttgtcaagtgcactccctgaattctctgctcctgggtcaggaaagctctggaacttcagggaaagcagtgctgggtgacccaatggggacccagaaagctggcccagggccagatacacaggcagcagggtgggtccctacagtgctgcctggtgggcatcaggtagaggggagtgaccaggaccaactcccctgagtgtcttcagggccaggtgaactagggagggtctgggacctggtgtggacccatgcactgacccaggaataggacaggaaactcctcagagcaaggactgtgttttcctcatgctgagctcctgaaaagcagtcttgccaggatagagtgggccagggtggatatatgttgggtgaatgagcttctgtctctgttttattgcaggagtcactacgaaggtacgctggccctgtatttgtatccagaaccagtcaaagccacctgtgagtcctgcatccctcagtaccaagccccagtcccccttcaggaccacccaccacacagagagacagacgtgcagggagcctgaggaagaacctgaaacctcctctactacatggagtgtttgtatttccatcaggaatcttgagcaccttgtgccgggtcttgaggcaggaaggggccacacagagaagaggagtttcttccctgaggtcagcagtccatgaacgaagggatcagggacttgagcagcagattctgaagcaacacctggacccaggaggcccctgagcctccagcagcccgcgtagagtggccaccagggggcagcagagagtaacctggcagaagcacctggagatggggtgggcctgggcatcagggagatgcccacatgcagggagggtcggtgaccatgacctgagatctggagggaaagaggttcttcttttcttagagtatttgtccttgacaccgatgtttacattcttctggcttcctggttctcagatctgactcttggagatgatccttatttttctgacacacattcaggcactttgcctcttcccatcgacctggcccccatctcactgtcacacatgccatcccatcctgtagtcagacgtgtcccacctccctgcctttgctctgggagcccctgtcctgcagacacagccacttctccttccctggccacccctcaacgtccactgtccccggtctttcctgactctgttctggggaacctgccaattcgtagttcttgatttccttatgagacacacaatacttactcattaatcttttgttgacttaagtttttatccattgttacattttcccagcaacagaagacaacttagttataataaacacttacttcctgggtcttggagtttgcagccccctctcattttctcatgaagcaaacatttccttcacctcctgatctgtccctggtcctgacagcaccctggtgatactgaggcacagcacccatgacctgacactagaactcgcagccaaggtagaaacttaccgcatcccatggatcttccaaaattctatgtgcccttggcaaccaagaattgcattctcctctagcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacggtgacacaggcagatgaggaagtgagacaaaaacaccctcccagcctcggtcaccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacccacctggcactgctgagaagcccagcagctcagagctgtgccctcactgggaagtgctgttggttgcagaaagcttcctcaagtttgtgtcccttttcagaggggttcggtttaatcaaccaagatctcaaatccttgcctcaatttaagatgccactgaatgaagggcctcccagctccagagctccctgtgtggatacctgaggcctcaatgtcaactccatcacgagtcagggtctccttctgccccgtgttgcctcccccactcccttctgaatcttctgtgcatggacatctctattgcagagttagcttccagagaaccccatctaagatggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcgatgtaatttatctcatacataatttcatgttgataacgtgaaaatgatagtattttgctctactgaaataaataaaatatatatatatatctgaatttatttgtcttatcttttcatatttaatgtggtgactagacactagggggtcacaggaggatcgtgtcataccactatgggacagagctcctcacaactctttcaggtgacaggtactgttgagtaacctgctgcaagcatccccatctccaccagaccatataagtgtgaacccaggaagaggcactggaacaatagagagaaaaacctgcttgtgcagaagacggtgcccttgagccctgctcctgctccatcctacgggtgccacattcatctcatggtgtaatatttcgtgccctgcctgagcttatgaccgaggggatatggcaggtctgactgtgtggttactggtgtctcatgaggttctggatgtaacaaagccctcgaatatagaagaggttgttttcaaaaggaaataattatctactgcacatgacatagacttgttgctaaatcccatgcgtctacactaggattctcctctgaagccttgccttaagcacaaggtttcagttcctatgtccagttcctctattatggtagagtctgctagtttctctggcccaatagcaggacactcactcccccacctgcacctgctgcagagcctttctactcttggccccaaaacactgggtgacacagttctcagacccatgatttatagtgtcagtattcaggcctcaggggtccctgatggcttctctggctccaagtctggaaacacagcctccatgaccatctctgggttccaggctgaggatgaggctgattattactgcaactcacataggagaggtggcactttccaccgtggtccaagttcatggggaattgagacccaaacctgccctgggctctcagcctctctcttgttctgaagatgcttcctcaccctgtgcaaggggcttcttgcagcactgccttgagaatttcccctctcccagctcctctcctttctcaccaggaagtccaaaaggaaacctgctctgtgatttctcatccaggacagtgacagcttcctgatgcttgtgtgctgtggtccctgaatgtgcaactcttcctagctcttcaaatgcaggcacatagtgagaaaagctgcctgactggtgcattcactgctgtttttaaggatgtcctcacccaaaatgcatcctcctcccaaattgtgaagaacaatctggacagaggtcattacagggagtttcaagaaactgcatcttattcaattgtgtccaccatggtctggtaaagatggccctcctggatggactattcctctgcatgtctgtcctgaagcagtgaccactgtgagaagatctgaacatgtttgtgaggtattaaggacgagaggaaactgttgtttttattattcttttgtttttgtttttgaaacaaacttttgctttgtcgccaggctggagtgcagtggcagaatcttggcttactgaaatctcagcctcccaggctctaccaatgctccctgcctcagcctcccgaagagctgggataacaggtgaccaccaccatgcctggctgatttttgtatatttagtagagacgggatttcaccatgttggccaggctggtcttgaactcctgatctcaggtgatgcacccacctcggcctctcaaagggatgggaatacacacaggagccactgcatctggcagtgttttttttatttttgctcctcctctttgcctcaatacctcaggttgctgagctggggagattttgcgtgacaggctcagtgctccctcaaaatcctcccgtctcaattcgctggggccctgtcctggaaactccccaaaagtggatggtgtccctataggttgggagtttccaaaatggccccacagggaagagttaacgtgagtccattccttcttcctcattgacatccagcatttgtaatttccatgggtgtcaatacttttgtagctgaaatctttcttaatctactaaaggtgagaatgaatttaataaatattcagacattagttgcatccaatatttaaattttatgagtcaattggtagacatagccattattatatataatttaggcttcataaactttgattaaataggttttattaaaaacaaagtaaccattttattatgtgtttagactatatcaacatgttgtgtacctgaaatatccacaagaaaatatatttcaaaaaccaaattgtatttattgtctattgttgcataaaaattgctccctaatatttagcatggtaagagaacacgtgtttgtgatcttgtcacttcggtgcatctggaattgagagcagcttagttttgtggttctggttctgggttggtcatgaagttgcagccaagctgtcaggccaggctgcattcagaggccagagcaggtggccaggcccagcctgaggggcttccactgtccctaacctgtttgtctgatgtggaaaatctcagaggaaaaggagagagtgaagtgtaaggcacctgtcccagtcccccttgtcaaaggccatcccatacctgcaccatttcttattctttcctggggcgtcataggcatagagcactgcccattcattctaacgctgtagagtattctgtagtaggattttagccatgcagcctctaatggttatcaccatgattttgatcttacaaatcacactgcagcaagcatccctgtgcagactcctttgagttcatgtgtgcatatcaccataggataaatttccagaagtggaattgctgggtcaaaaggatgtgcatttttaacttttatccattgttttcatattcccctccagttctaccagtttacaataccagccctaaatattgattggaattcattggtgaaagtgcaagtttgtgccaacctatcagatatacaaagttatcttgttacacatttatttttgatttctcctattttgcttgaggttgagcatttactcaaatatttcagtgctcattatgttttaggatttggtaaaccgtttcttcaatgcctcggtaagaggtattttagtctttgccatgcacaagacaacgttgggataatatgtatgttctgatacaccatctacaacgtaatcattaaaacatataaaaaccactatcagttctggggccattaaaaaaattggtggcaggccagggatgtcccacaggatgtggtttaacggtctctggtttctagggttatttgaagtttgaacattgcacccgcatatgttctatgtggagatctctttgtgagggacactgtaattcacctcctctaggggcctgaggtctttctttggataagaacctacctgtaccatgtgtttgattggatcttgtgtctgctcaagacagccctgtgtcacaagctcatgactttcatcttcatccatttgctctgttttgtgagagcttcagtatatcaggaatagagattcctccgaggtgaaaaattagaggcagagggaggggcaaatgggcaaggaagcttgcaccaagtcgggagtgatccagtgtaggctgagagaaaaaaggtcttaaaatcagccttgtagctgaaaccaaaaacacacaagatggttggtgttctgagcatcattaacaaatgataaatgaagttgaacttttaaatgtattgcaaatttttataaagcaagtagatcgttaaactcagaatgcaacaatggaataaagaagagagtttgagatgtttttaaaatttatttatttatttatttatttttgagatggagtctcactctgttgccaggctggagtgcagtggcacaatcgcggctcactgcaacatccacctcccgggttcaagaaattctcctgcctcagcctcccaagtagctgggattacaagctctcgccatcatgccaggctaatttttgtattttttgtagagacatggtttcacaatgttgaccaggatggtgtcaatctcctgacctcatgatccacccgtctcggcctcccaaagtgctgggattacaggcatgaactaccgtgcctggctgagtttgagattttaactgtaagtcctccaactaagttgccatgacaagaacagggatgatgagagtggaaatatgttatcctgcaaattatcgttttatgtaaaagaatattttccctcttttaggtaaaggaagcatcttctggagcaccttctctctgactatcaaagcaccattaagccacaaataaactgtaacatgaagtaggaaacaactgcccttttatataaccattgagaggtggctttatatgcataccaaaatgttgatgctcaatgctaaaattggatttagtaatttaatatgcctacaagaaattaattttctttggattatattatttctgtgtacgatttatcttagttaacttggaaatattctgctctaaaaacaactcttgttttttgggttatattttctgtatcaactatagctcttttccaaatgctgtcagagatagcccatggctactgatcacaaaattcaattttatggcatttaaattattctatactctaaattattttaaaagtgcacagatgtgaatttttcacatctgactcaaaaatgttgctgatgttgactcacttttttatttcaatcttattgaagtaggagtttacttttctggaacctggatgataacaggagactggagaggaaaccccccaaattgttttcctttaaaccctcaggatgaatcatcctggataatcacccacacttgatttgggtgatatctaaatgagagttgggtcttagagtaggtgctgagttagtttaggacttgcgctgttggaatgagttgaatgtttttacaagtgagaaagacatgagttttttggagtccagagggtggggggttattggctgaattaagtcccccaaaatgtatgcattgaagctgtaacacacaatatgtgactgaaattgtgcatagggtctttaaagaggtgactaagtgaaaatgaaaaaattagggtggattcttctcaaattggactgatgtcctcctaggaagaagaaatttgcacacacagaaatgaggcaccagaggtgagcgtgcagagaaaagaccaggtgaggattcagcaaggaggtagcaacctgcaagccaaggagagagtcctcaggggaaaccaaacccactaccacctttatcttgggttttccagcttcagaactgtgagaaaatatgtttctgccatttcggtcactaattctttcctatcttcttgtgggagctctagcaaaaacaagagggaccccaaagaccttggatgagggagaaggaggagatggagcagggtgcaggaggcggtgcaggaaggggctggaaggtcgggctctgaggtgcatctcctgggtggaatcttgactccactccctattgtctggaggacttgggaaaaacatttaacctcctaatattcactcactaataaagatgggcttgaagcacaaggctccccatcatcctattctatattacaaaagtcttcttgaggtaacacttgtaaaactctcgctaatgcatctggcatgtattatggactcataagtagcccttctgagtgatctagtgatgtgcagaaaatggcattcatgctgtgtgcaccagggggcactgtgaggtttagtctgaggcccctaatgagtccaagcccctagtaatgctcaagggcgaagagcctgactgttgcttcctatgaggcccc
